United States Patent 12,746,261 (PROBIOTIC BACILLUS COMPOSITIONS AND METHODS OF USE) - sequence listing, part 5

SEQ ID NO: 6 - DNA, 1000000 bp, Bacillus amyloliquefaciens
taaaaaaccatacattgaagtgacatacacgattccgaaggcggacacgccgtctgtcaaagcgtatcataacggagattcgacaggactttcaatatcagctggaaaaaagctgaaggcgccaaaagctataaagtgtggctttataacgggaaagaatatcaagccatttctgtcggcaatgcaacctcttggagcacaaaaggaaaaacatctggccgacaaaagcaaaatcgactccggcaaatataagctgcatacagacggaaaaggcggaagtgaattagcgcttaatccttcgccggtctataaaaaactccggcggcagctatccggcaagtaaaaattactgggtcgcggtcagcgcggttgaccagggagaaggcgccatgtctgcggccgccaagcccgtcattccgaatattggagttcagaaaccaagcacgaaaggctttaataacaacaacgccacaggctggtttgatctttcctggaaagccgtatcaggcgcagccgggtataaaatgcaagtctttaacggcaaaaagctttgaaacgcttgacctcggaaataaaacatcctggtccacaaaaaatcaaaacatctggccgacaaaggcggaaatcagcgccggaaaatatgcgcttcacctgaaagacaaaaaagcgcggaattgccgatcaacccgggccccgtttataaaaatgccggcggacgcaaaccggaaaacatacggatttaaagtaatcgcctataacaaagacggagaagcgatcgcctcaccggaagctagtccggcgctgcctgatatcgcaaagccgaaaatctgacaggctacgtctatacgaacacgaaatcgagccaaacgggttatgtcaatctcatatgggataaagtcaaaaacgccaaaggctacaaaatcaacatctacaacggaaaagactatcaatcattcgatgtcgggataccgatcattggacgacccaaaacaaacacatctggccgtcagccgatgaagtgaaagcgggaaaattccagcttcacacggacggaaaggcgcgaactggcgcttgacccttcacctgtttacgaaaacgcaaacggcaattacaaagggaagaaaactattcctttacgctgaccgcctatgacgcaaatggtgacagtataccgacggcaccttttaaccctgtttccatgaaggtgcggaattcctcggaacggaagaattctggtctattatcgacattccggacggacagctgaacggcgcgacgggaaatgtcatcgtcaatgaagaagatattcaatcgacggacgcggccggggctcggactctcccggacctttaacagccttgacagctctgaccatatttcggccaaggctggtatgccgatgcggaaatgtcgattctttctgaagacggcagagccgtttatattgatgaggacgcgacaacacatgtcttcacgaaaaaatctgacggcacgtatcagccgccgacgggtgtttatctcgaactgacagaaacaagcgaccaatttgtattaaaaacaaaggatcagacgaacgcttatttcagcaaaaaaggcggcaagcttcaaaaagtcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcgtattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcgggcaccgcctggccaaagccgttaatgcgaaaaaagaaacgtatgattacagctatgacgccggcaaaaaaacgctgctcatgacgcagccgaacggccgcaaagtgcagtacgctataacgaggcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacgtcactgatattgcgtacgacgacttgatgctgtttctgagacggatcaaagcggaaaatcctcatccgccgtgtatgaaatggaaatctcattcaatcaagcaaagagctggcagcttcggcaagcctgctgaaagacggcagctttgaagcaacaaagctgggctggaatctcaccgctacgagagacagcggaagcatcgcgtctgtaaaagcaagaagcggcgcgctgtccggacaaaaagcactggagatcacctcacaatccgcttcagccggaacagagcacggccatgcgtccgcaacgcaggaagtgcagcttgagccgaatacgacgtatacactcagcggccagatcaaaacggatctgacaaaggcgagagcgtatttcaacattgatctgcgtgacaaagaccaaaaacgcattcaatggattcacaatgaatcaggcgcattagccggaaagaatgactggacgaaacggcagattacctttacaacaccggccaatgcaggaaaagccatcgtctatatggaagtggatcataaagacaaggacggcaaaggaaaagcgtggtttgatcaggttcagctggaaaaaggcgaagtctcttcaagctaaacccggttcaaaacagcagtttcacggctaaagcagatggctggagcacaagcggagccgcgctgaccttgatgaaggcttcgatgatgacagctcattaaaagcgtcccgcacaaatgcatcacaagccaatgcggccgcaaaacaaaccgtcacattaggccaaagcgcgacgataagccggtatatatcacgctgacagggatgtccaaggcagacggcgtaaaattaacgaacgacaatgattacgcgcttcaggccggcgtcacctatgcggacggcacgacgggcgtctacaccgccaaattcccgcaggggacacaggaatggaaccgggcggcggcagtcattccgaaaacaaagccgatcaataaaatcgaaatcagcattctgtcaaaaaaagcgccacagaacggcgtgtttgatgacatcccgattaatcgaagaagcatcctacgaaaaacacctatgacgaaaaaggaaactacgtcacaaaagaaagacgaactagttatgcaagcactgcttcatatgacgagactggcaagaaaatgtctgaaaccgacgcgaaaggcgaaacaaccgcctacaatacgatcaggccgaccagctgacaaagcaccctgtcaaacggcacatccatccttcacagctatgacaaggaaggaaatgagctgaccaaaaacgattcgggccggcgcaaaccagacctatcatatgaatatacgtcatggcaagctcgtcaaaacaaccgaccgctcggcaatgtactgaagagtgaatatgacgccaacagcaacctgacgaaaaccgtttccgccaacggcaatgaagtgtcgctgacctatgacggcacgaccgggttaagtcaaaagcgtataacggcactgaaaaatacaactttacctatgacaaaaacggcaatgaaacgtcggtcacaaacaaagaacaaaatacaacgaaaaaacgcactttgacaacaaaaaccgcctgaccgaattaaccgaccgcggcggcagccaaagctggacgtatccggctgattcagataagctgaaaactttctcatggagccacggcggccaaaaaggaacaaacagctttacgtacaacaaacttgatcaaatattgaaatgaaacggcacttcagcctatacatttgattatgatgaaaacggcaatgtccaacattcatcagcggaaatgaagtcggcacgagcttctcatatgatgagcggaatcttgtcagctctcttcatatcggagcgaaaaacggcggcagcatcttccggaaagctatgaatacgacgccaacggcaaccgcacggtcatcgacagctcagccggcgaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcatcattcaatatcatgaaccagctgacgaagtgaatgagaagacctgtcctatgataaaaacggcaaccgcatatctgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgttacgaactacttctatgacggagacagcttgaacgttctgtatgaaacagacgccgacaacaacgtcacaaaatcatatacgtacggtgacagcggccagctgttatcctatacagagaacggcaagaaatatttctatcactacaacgcacacggcgacgtcatcgccatctcagacagcaccggaaaaaccgttgccaaatatcagtacgatgcgtggggaaatccgacaaaaaccgaagcaagcgacgaagtaaaagacaaccgctaccgctacgcaggctaccaatacgacgaagaaaccggcctgtactatctcatggcccgctactacgaaccaagaaacggtgtattcttatcactagacccagacccgggcagcgatggggattctttagatcagaatggatatgcatacggaaacaacaacccggtgatgaatgttgatccagatgggcattgggtgtggctagccattaacgccggctttgcggcttatgacggatataaggcatataaatcaggtaaaggatggagaggtgcagcctgggcagcggcttcgaactttggtcctgggaagttatttaagggtgctaatcggatttataaagctgctaaaacatataaactatctagaaaaagtgtacggctagaagggcctactcaagttatagggatataactggaaaaacttctagttcaaaaattattctactaatgtaaaaagaagaactttgaaaaaatttaagaagacaaggatggagaaaatcagttcatcatgggggtgttatcactatgacgaaaaatggaataagtattccctaaggaaacatgctaagtcaagtccctatccaaccgcggaatatacacctaaaggtagaaaaaaattcacacacaaaatcagaatgcgacattaaaggggaaataagatggatcactatttattgatcatcctaaggagttaaaagtctatcaatccataattaattccttatgtcacgtagatcaaacattgcctaaacaagtttttaagcaaaggaaaaattattatttatcgaggaattccattgggtatatctgaagaaagttggggaatgtttaagagtttggctaatgaacatcatgatgagtttatattaatggctgttatagacagttctgaacatataaaccaattctacgaagaatttgagtattttaactggataaagatccctttgcatataactgcagatgagtatctgtcactcttaactgattatccaaagcacagtaaaagtgactgtataatgaatattgcatctcgtgtgtttgggcttcaccgactttaaagtgggcgatttatggtgaagagaacttgaaatctgtattctaggtattgatcatcagagtgaaggaaaagaactagcaacttggagatcgttagatggcgttgtcttagattggatatcagttgtattcccaaatcagacggttccagttgaatttgaaaaacacttacggcacattacaaataagtatattttaatacctactaccgatatcatctgattgttctaaacgggatttcaaataatctccagatagtatttttgcattcaacagatatttaatgacaaatatgcagagtaatatattttggggcttgtttgaataatctatgtttatcatcaagacacttctatcaatgggtttgttagtgttagttaggagaaggagaagacaatgcacaaacaaattgaacaatagagtagattatattgacgagggatgtaatattttaaaggtcgattatcagttctttaaaaaagacctgttttaaggttcaggttgttaaaaatgcagcatctgttatttagtgcagatattggtgatatgagattagaaaaaatagattcggaagaatacaattggcaagtatttgagatgagttaccacccggaaggaatcggtaatctatcaaatgctgtaattccggagtatcaatcaaatgctaattttctcattgacatgaacagaatgctgattgctgtagaagctgaaacagttcgctttgacgaccaatcattttatgcgtatcatccgaaatcataaataaacaaataagagaggttcccagcctctcttttcttacataacgaaatcgttcgcggaggcaaacatgaacactcctttaaatttacaaaaagaatcattgagggctatagggaatctggatgtgattaatccgcttaaatacaattcgatttattcatgtgatctagtgagtaaagatactttttctcaaattaatgaatgacttagagttcgaaacagctctaatagaagtaatggcattcccttcttttattgaagaatggaagaagaaggttgaaaagaaaatgataaatatgaatactgtatcgaaaaagttcattcatattgaatgtgtcctaaccaaagaagaattgatggcagattacttattagatgaattatattttttagcatcgatcaatgattttgttgttataatagcaaaccctgccaaaaataagtcctgcatgaacctgaacactcaaaaggttgatgtaactactgaaagtaatgaaaaaatcatttggtttgaatacgatgcagcagatttatatatcattgattaatttaatataaatttcaggttcctattcaacggagtgttgctgatgttaaaacttaccgcggagcgtgttgggtcatatgaaagggaaaatatcatttatttcaatgcgggtcgggatgatcaagtatttattgtgtcggtgcacgatcacaaagtaatattggaggttatgaaaggcagctctcttttaatcaaaaaagagttacacggattttctgaagatgcccatttctatctgattgattcgtatgatgacactatcgtgatcgtttacctggagaatcatacgtgtcaattggctgcatactgcgtaaacagtaataaaatcaatccgatttgttcttttctattaagcgccaatgtatttcatctgggtgaggatggattattatggatcggattaacggacgagggtatgtatgatgagagaaatcctcaaggaaaagcgatatttgcttttcatgcagaagacagaacgttttattttgaagacgattttaaagaaatgatgcacgaatgctatgccgtacaatcgatcaaatctgatttgtatgtatgtttcgagggagaggattgctgtgtcatcgggcattatcagattggacggacagaattcgtactgttgcagaatatgtgctggacggcgatcaatactcctattgtgatcagctatccgttcgaaaaaaagggtgctgctgattcagagtcacgatgataccctatttgcatttcatgaagagcacaaagagactgacgtcatgatacacggtattgatagaaaaggagaaacaacgtacagagccgtacaggatcgcatgtttatctttagtgataacgatttatatctggtaaagtattgatcaatcctatgcagatggctttttacagccatctgcatatcattttacggagtgaacgatcgatataaataggataccatccaagactcaaggggcaatgacatgaaaataaaaatgaataagatagtcgaagaatcagtaaaaggatgtttttgtcattttgataactgcgggcgtctgtatctcggacggcatcagaatggcgggctttcgtttacgatcatcgacaaatcgggcgatacgcgagtgattcatatcgatgaacaaatcccgtatgaggatattatgctgttccaacagagttcggctgactggtatgtgttgattttctttgaatcgcatgagtataaagtgaaagtattttcagcagaaggaacagaacaaagtgcattttctctcccttcaggggtttcatgcagtcttttggatgaaaaacaaaacctgtggatcggtttaagtgatgaaggtatttatagtgatgaaaatcctgaagggcacagtgtgctgtgcttcactttagacgggcagctaaagaaaacccacattgatcagcagctttcagaaatatatgcgcccgcggtagatgactgttatgcacttgcagaaaaagacggactaatctacatgctgtattacgcttatacagtcattgctgcgtttgaagaaaccgacgtgaaacgagtgtggattatttctgataaagcatattccggggtttacgaccagctagcgatttcagataacgggttttgggtatgcaaagatgatcattcactgtctctcattccggccgatgtcagtctgccgatgcaagagataacgtgctgtgatgcggatggcgatgagctttccgggcatcagctgaagctgactggcgatgccatttacgcggtctcgaattcagggatttataagcgggatatcagtaatgggaaagcggctaaatgagatgttaagatccaacagatattctttaaataatgacgtcatcagaagcttgaaattacacaaaaagaattagaggggccgctgccttcagatgcagggagattcgaagaagactttgagggtgctgcctgcgctggggatttttatgaatacttcgcacttgtctgcggcagcttagattttgttttggcgaataaacaaatgcctgcacggcagcgtaaagccttatataaatccttttttgagctgtatccgcaatatgcgcagctgaaaaacgctttgatggattatccggagctcagccaggaaatcgggcggcacgaacgggccaggaggctgttagtcagcattttaaacaagaaatgaaaggcaggattttgacgtgaaagaacccacaagagcagaatgtctgaaaaaggctggtctgatcctgaacggtcaagcggcgagggaagaagtgtcggattgggcgtctgagtatgtgagtgcaggtgatccggcggatgaggacgaaaccgtttgggagatgctcgtatatttgagcgggtttgatctgaaagattcgcctgatgcgtatctgcatacgatagaagaattaagagattgggtgcaggaatataaagaagttcatggggatttgtaagaaaaaaattcatttgagtcagacatgtcaattcagctgaaaaaaaggaggcgcaaaatggaatggcacaaacatgagaaagcagttctgccggggccaggttcgccgggttgttttgaattgacggagtttacgttctataccgggtataacgagtattatgataaaatcccggtgtttgagctgaagctgactgacggacagtatgatgccgtgctgcggtttgaggatgtgaggtctgcccggctggatgatcttgaaagcatcaccgacatccatctggatatcagcccagtcgacggcggctgggaatcgatccgctactatgtcgatgacggggaaggaagtatgagcttttattgcgccaaatgggtcgtgctcgacatgaagaaaaagcagtcccccgaacggcccggcaaaacgtcagggtaaagcggcggcatttcgcgtataatgaggggagccggacagagaaggagtttagtcatgaatgagtttaatgaatatgcgatcagccccgagatccgacgggcgctgaatggcttgcaatacaccgagccgactgaagtgcagcggcgcgtcatccccgccgcgctgcaaaaaaaagacctcgtcgtcaaatcgcagacgggcagcggcaaaaccgcggctttcggcattccgatctgcgagcttgcggagtgggaggaaaacaaaccgcaggccctgattttaacgccgacccgcgagcttgcggcgcagattaaagaagatatcacgaatatcggccgtttcaaacggataaaagccacggcggttttcggaaaagcttcttttgacaaacagaaaaccgaactgaagcaaaaaagccacgtcgttgccggaacgccgggacgtgtgcttgatcacatagaaaaagggacgctgccgcttgaacggctggcgtatgtggtgattgacgaagcggatgaaatgctgaatatgggatttattgaacaggtggaagccatcattcagcatctgccgaaaaacagagtcaccatgttgttttcagcgacgctgccggatgacgtcgagaagctgagccgcacatatatgaaagaccctgaattgattgaagtaaaagcggaaggcctgacgacaaaagacattgagcattttgtcaccagaacagaagaagaggataaatcatctttgctgcgtgatgtcctgatcaccgaaaacccggacagctgcatcatattctgccggacaaaagaaagggtcatccagttaaccgatgagctggacaggctgggctacccttgtgataaaattcacggcggcatggtgcaggaagaccgctttgacgtcatgaatgaattcaagcgcggcgagttccgctatctcattgcgaccgacgttgccgccagaggaattgatatcgaaaacatcagcctcgtcatcaattatgatattccgcttgaaaaagaaagctatgtgcaccgcacaggcagaacgggccgcgccggacaccgcggacgggccgttacgtttgtgacgccggctgaatcgcggtttctgaatgacattgagacatatatcggtttccgcatccaaaagcgggaggcgccgtccgagaaagaaacagcggaacggaaagcggcttttgcggaaaaattgaacgcccgccccgatgtcaaaacagacaaaagcgaacagttaaacaaagacatcatgaaactgtactttaacggcgggaaaaagaagaaactcagagcggtcgattttgtcgggacgatcgcgaaaatcgacggcgtttcagccgatgatatcgggattatcacgattctggacaacgcaacatacgtcgaaattctgaacggaaaaggcccgcacgttcttgacatcatgaaaaatacgacggtcaaaggcaaaaaactgaaagtccataaagccaagaaataaaatagaaagcctgccgcgtgcaggctttttttacgccgtttcctcaggcacaaacgcaaggatggcaatgccgatcacaaataacaaaatcaggctgaacacggcggctgacgaatttccggtcagctgggcggtgacggcaatcaaaagcgggccgataatcgaagcgaacttgccgaagatattataaaatccgaaaaactcattggcgttctgtttggggacaagctttgcaaagtaagagcggctcagcgcctgaatacctccttgggaagtggcgacaagcatagccaaaacccagaaatcaaaagcggaatccataaaataagcatacgtgcagacaatcatatacacgccgattccggcataaagcattgtttttcctttaaaccgttcggccagccgctcgtacaaaatcgaaaaaggggcggcgacgacctgtgtgacaaataaaacaatcagcagatttgccgcgctgatgccgaggtcagccccgtatgacgtggacattgtaatgatggtgccgaccccgtcgatatagaagaaataggcgagcagaaacaaaaacagcgcccggtgcttcctgatctgcttcagcgtgccggccagccgtataaaactgctgatcacaagccgcggctccctctcgatataatagcgctggcggacgcggagaaggagcggaatcgaaaacagtccccaccatgccgccgtaattaaaaaggcaatgcggcccgcagtctgggcggacagcggaatcacctccgcttgtgctgacagaatcacggcaatgctcaggagaaaagggattgtactgccgatatagcccagcccaaacccctggcggacaccatattcatccgctcctttgcggccacatcaacgagaaacgcatcataaaacacattagatccggcaaagccgatcgtggaaatcgtataacaaattaataacagcatccaagattcgccgggaatcaaagccagcgcggcggtgcccgccacaccgatcagaaaaaagaaggcaaaaaaccgtttcttgcatcctttgtagtcggcaatcgttcctaagacggggctgagcatcgccaaaataaaagtcgcggcggcaatcgtatagcccaaataagcggtggaatcagctgcgctgacgccgttttccgccgccgccgctttaaaaaacaaggggaacaccgccgtcataataatgaccgaataagctgaattggcccaatcatacagcatccagctgctttcttctttcgaaaaccgtttcatcacacacgctccttcccaaaaaccggttctctgcattatatgcgcctctgcctcatcgttggacaatgatttctgaacggcgttttctgattgacctggagatattgacctggtacaaaaaggatgtacaatcaaggtgtagcaggtaaatggtcaggcgggagggagacggaattgaagattgcgaaagtcaataataataatgtcgtcagtgtgctcaaagaaggcaatcaggaattggtcatcatgggccggggcattgcttttcaaaagaaaacgggagatccggcagatgaagcccgcattgagaaagtgctcaccctcgataacaaagatgtatccgaagttcaaaacccttttgtatgatattccgatcgagtgtatgaaagtatccgaggagattatcagctatgcgaaattacagcttggcaaaaagctcaacgacagcatctatgtgtcgctgaccgaccatattactttgccattcagcgcaataagaaagggctggatatcaaaacgccttgctgtgggaaacgaagcggctctacaaagacgaatttgcaatcggaaaagaatcgctgatcatggtaaaaaacaagactggcgtgtctctgccggaggatgaagcaggttttattgcgctgcatattgtaaatgccgagctgaatgaggagatgcccaatatcatcagcattacaaaagtcatgcaagagattttgagtatcgtaaaataccattttaagattgaattcaacgaagaatcgcttcactattatcggtttgtcacccacttaaagtttttcgcgcagcgtctttttaacggcacacatcgactttttgctggagaaaaataccgtcgggcgtatgaatgcacgaagaaaatccaaacttgcattgagagggcgtatgagcacaagctcaccagtgacgagctgctgtatttaacgattcacatagaaagggtagtcaaacaagcataatgaaagcgttggcattattgttcttggattcattttttcttacattcacatatgatcttgttaggattgttgctgataagcatgcaaaacctaaattacaatgagcgcggatcatttctgtttgtgctgatggtaatttaggtttttttaagattcgttattatcattattctgaccgatgttcccttttaacagaatcatgtatgatcgataaagaaatcgctctcaaagaaaggggaatgccgacatgttttatcgtatgaaacgagtgctgctcattcttgtcactggattgtttttgagtttgtgtgcgatcacttctgctgcatcagctcaaacaggcggatcgttttttgaaccttttaacagctataactccggtttctggcaaaaagcaaatggttactccaatggagatatgttcaactgcacttggcgtgcaaataatgtatccgtgacgtcatcaggtgaaatgcgtttggcgctgacaagcccgtcttataacaagtttgactgcggggagaaccgctccgctcaaacctatggctatggactttatgaagtcagaatgaaaccggctaaaaacacggggatcgtttcatcgttcttcacttatacaggtccaacggatggtaccccttgggatgagattgatatcgaatttttaggaaaagacacgacaaaggttcaatttaattattatacaaatggcgcgggaaaccatgagaaggttgcggatctcggatttgacgcggccaatgcctatcatacgtatgcgttcgattggcagccgaactctataaaatggtatgtcgatgggcaattaaaacatactgcgacaagccaaatcccgacaacaccgggaaagatcatgatgaacttgtggaatgggataggtgtcgatgactggctcggttcctacaatggtgtaaatccgctatacgctcattatgactgggtgcgctatacaaaaaaataatgtacagaaaaggatttccgccagcggaaatccttttttaattaaaacgaaataatcccaatcaaaagcgccgcaatcgtcatcacaatcgttgttcccacggcccatttaatagtgaatttttgatggtcgccaaagctgacgcctgccattccgaccaatagataggtggatggcacaagcgggctgagcagatgcaccggctgtcccagcaaggaggctcttccgatttcagcggcgtctattccgtaagcggaagcggcttcggcgatgatgggaagaacaccgaagtaaaaggcgtcattcgacatgaaaaaggtgaaaggcatgctggcaatcgccgtgatcaacggcagatgcggacccatggcatcagggatgagggaaacgagagaatgcgccatcgcatcgaccatttttgtgcctgagagaatgcctgtaaatatgcctgccgcaaacaccattgagacaacgtttaacgcattacccgcatgcgccgaaatccgtttctgctgctctttgacatttggatagttaatcatcaaggcgatggcgaacgcgatcataaaaagaacagggatgggaagcaggctggtgatcagcgcggccatcagagcgacagtcagcagcaggttaaaccactggagagcgggacgcttcagcggcgccgcctccggatcagaagacggcgcgtgttcaatcgaaatgatgccgagacgcttccgttctttttttccaaggagataagcaacggcgatcacccagagaacgccggcgatcatagcgggaatcagcggcgtaaaaacttctgacgtgtccaatttcaaggaagccaaaaccctcgccgtcggtccgccccacggaataatattcatgacgcccgaaccgagcatcgcaatccccgccagcaccaaacggttcatgccgagccgtttgtaaaggggcagcattgccgcaatcgtaatcatatacgttgttgtcccatctccgtccagcgaaatggtcatcgtcagaaccgctgtgcctacggcgatttttaacgggtctcctttgacaaacgataagattttggcaatgagaggatcaaacaggcctgagtcgatcataatgccgaaatacaggatggcgaataacagcataatcccggtaggagcgaggtctgtaacaccctgaatcatcatcccgccgagatctttgccaaatccgctgatcagggcaaacacaacaggaacgacaatcaaagcaataagtgcggaaagccggttagacataataaggtacataaaaacaatcatcatcacaaaaccgagtatggcaagcatgatatgacctcccctgttcaacagctgttttggtaagcgctttcacattttgtttctgtgaaaatggcttatttcaaaatgtgtatgaccgcatatgtaaatacagacctaaaatcctaatgagcggatcagcagtttatttaaagaacgccgcgggtaaatgtgctgtagaatgtttcgttttaaaaggggaactgacatgagtgatgatcaaaacaaacgagtaaatgaacactcaaaggacgaacagctggagcagtaccgatctgataacagcggcaaaaaaatgacgaccaatcaggggcttcgcgtgtctgaggatgagcattccttaaaagcgggcgtccgcggccccacgctgatggaggattttcattttcgtgaaaaaatgacgcactttgaccacgagcggattccggaacgggttgttcatgcacgcgggtacggcgttcatgggcattttcaggtgtacgaaccgatgacggaatatacacgggcgaaatttttgcaggacccgtccgtcaaaacacctgttttcgtccgtttctcaacagtggcgggctccaaggggtcagctgacaccgtccgtgacgccaggggatttgcgacgaagttttatactgaagaagggaactatgacctcgtcggaaacaatattccggtgttcttcattcaggacgcgatcaaattcccggatctcgttcacgccataaaaccggaaccgcacaatgaaatgccgcaggctgcgacggctcatgatacgttctgggattttgtcgcaaacaatcctgaatccgcgcacatggtcatgtggacgatgtctgaccgcggcatccctcgaagctatcggatgatggagggcttcggcgtgcatacgttccgtttcgtcaacgagaaaggaaaagcgcgctttgttaaattccactggaaacccgtgctcggcgttcattccctcgtatgggatgaagcgcagaaaattgccgggaaagatcccgatttcaaccgccgcgacctatgggaaacgattgaaaacggcggcaaagtcgagtatgagctcggtgttcagatgattgacgaagaagatgaatttaaatttgatttcgatatccttgatccgacgaagctgtggccggaggagttggttcccgtcaagctgatcggaaaaatgaccctcgaccgcaatcaggacaatgtctttgcggaaacggaacaggtcgcctttcacccgggaaatgtcgtgccgggcattgatttcaccaatgatccgcttcttcaaggccggcttttctcttatacagatacacagctcatccgtcttggcgggccgaattttcacgagattccgatcaatcggccggtctgcccgttccataacaaccaatacgacggctaccaccggatgacgattaataagggccctgtcgcctatcataaaaattccctgcagaacaatgatccgtcgccggcctcagaagaagaaggcggatacgttcattaccaggaaaaagtagaaggcagaaaaatccgccagcgcagtgagagcttcaatgactatttttctcaggccaagatgttctggaacagcatgtctcccgccgagaaagaacatatcatctccgcgttctgttttgaagtcggaaaagtgaacagcaaggatgtgcagcagcaggtggttgatgtcttcagtcacgtcgacgccgggcttgccgagcgtgttgcgaaaggaatcggcgtgaacccgccgccgaaggaccgtgaatctgatgaaacgttcacttccccggccttaagccaggaaaacacggtgaagacggcagcgacaaggcaggttgcggttttaaccgaccacgggttttctgatgagaaagtcaaacaagtgcttgacgcatgcaaacaggcgggagtcagagccgatatcatcagtcctgtgcttggaaccgttaagggagaaaacggcacggagctcgaagcgtcagccacgttcctgacagcggattccgtcctgtacgacgctgttttcattccgggcggaaaacaaagcacagacagcctcaaagcccaaaaatcggccagagacttcgtcaacgaagctttcagccattacaaagcgatcggcgcctccggtgaaggaaaagaacttctcgccctcgccgccggaaccgaaagcggccccggtcttgttccggacggaaaccatgaacaatttctgaaagccgtggctgagcatcggcattgggacagaaacgtataagaatgaaaaagcgcctttgatgagaggggcgcttttttcttgtgaaagaatattgggagaaaacgaaaattgcttccgtacaaatccgtatcttccgctgtcctggacattcagacaacagttttagagagtcagggcatgcgctatttaaagcaggcgggttgatgaaataatagtttcaccctctttggtttacttccgccctgtgtttgtgtatcttaggggtagattttctggaggagcgattgatagtgaagccgtttaccgaaaaacaacttgaagaatattaccggcgtgacgaaaacatgatgattttggtgtttgcccaatggtgcgtcaatcatgaccttgatccgatggccatttacagcaaagcttaccccggacagcctttaaacgaagagctgcgaaaaacggctgaagagcttgtcgtgccgaaggaggaatcagaaccgattcctgatcaaaccgtcatcggcgttttggagatgttcggcaactccgatttggcggaagccgtttatgaagccattgcgcaaagaccttcacggtaaaagaggcgtggattatccatgtctctttttttcatggagaaaatgtgaaagaaggcccagaaacaatttgctgatctgcgctgtctatagagtgtaatccgttttcaaaaagggaacggtaatgaaaaggaggagttgtgatgaaaaaggcattcaaaatgatggcggccgtgctcttaaccgtgctgacagccgcgccgttcggaggtttcgcgccttcagccgaggccgcgcaaactgcaaagcccgtcgtcaaaagccagacgtataagcatgtaaagcagctgacgtaccccgaggtcacaaatacgggaaacgcatcttttgaaaagaaaatcaatcaggacttcaaacgctatattgaaaactcgtaccaagaatatgtaaaaaacaaaaaagacggtgaaaaacaaggctacaaagcggaataccaggcagatttcaaggtgaagtataatcaaggcggcaagctcagcattcagacggaaaactacagttacacaggcggcgcacacgggctgacagccgttcagacctttaattacgacctggccgcaaaaaaacgggtcacactcaatgatgtgctcaatacaaaaacgaaagccaacaaaacgagagactatctttacggctacatcaagaaacatgacgatctgtttgaccaggacgtcaaaaaacaagagatcatcctgaataacgaaagacctttcttctttacgaaaaacggcattgccgttgtgtttggacaatatgatctcggaccatacgcggcaggaatccgggacgttttcgtgcctgcatccgtctatcaataaaaaaaagcgatatcactctaaaacggagcggtatcgctttttttattttaccagacaaacaatccgacaatcgccgcgctcaataaggaaacggcaattccgctgacaagcagcttccagacgttttttccgatgatggctgacttttcaccatcaagcagagattgataagatccgtagatcataccgatggtgctgaagtttgcgaatgatgtcaggaatgtcgtagccacggcaatcgtgtgcggcggaagtgatttcagctgccctttcagatcggccattgccacaaattcattcgtcgcgagcttgatgcccatcagctgtgcgacatacatcgcgtcatgtacgcctaatccgagaaggaaggcaaacggactgaagatgtatgagaaaatcttttgaatggtcaaaccgtgcatgaacagtccgagtacgccgtttaacgcagccgttaacgccacatatccgattaccatcgctaaaataacaatgaccatgttcatgccgacaagcatactgttagaaatcgtggagaagaagtcttttttctccgcttttgaaggaacgtaaataatatcatcctctttagaaacgtccacgggattcagcatattggcgattaaaagcgcgtttaagcaattcagcgggatagctgtaaacacataagtggacggaaccatcgtcaagtacgatccgatgatcgaaccgctgatgctgctcatgctcatcagcccgaatgtcagaagccgattgttgctgacggcggcaagctgctggcggatgacggctaaagcttccgtatttcctaaaaacatcatctggatggagaaaaagctctccagcttcggcagacgggatattttagaaatcagccagccgattttatcaatgagccacggcagaataccgaaatacgacagcatatcaaagaaggtcacgacgaagataatcggcagcaatgcgctgaagaaaaaatcaaccgtcggattggccatgatagacggaaaagcgaacgcaattccttgactggcgcaggaaatcagccatgtaaagaacgcgccgatcttcccgatgacaaagccgccgacttttgtccctaacataaaccaagtaatcagaaactcaaagacgaggagcatgacaatcggacgccatttaatcttcttcttgttgggagaacataagaaaacaacagccatgacaacaatgagaccgacaatgttcaataaaaagtacatgtgagcaactcctataagggtattatggaaataaaaaaagctcttattcgtcacaaattcctgaaagccagaaagtgtgataaataagagccaaaagaaaagaatagactgagagcatcatatgcttttcactcgttcaaatttatgcaaactttcttgtagtctagtcttttacggcactaggtagaaacaatcagaccatattactgatcatatacaagaataacgatattacatgagatagcagtattttatcgtttcaatttttgaaaatcaacctttttagatattttcaaaataataaatttatattataaataaagaaaataaaggatgttcacaagtaattggattaaaaaggtataaaaagcccccgaaaaacagttccggttcattgtaaagacgggatgcagctgataaaatggatctgagggcaccgccttcaaaagacggcagaaaaggggtcattttcatgatcattcagttcattcgttacagataatgagaggtatagataaataggttaaacttccaattttgcgaggtttatttgtctatgcctttttcatttcatcggaataacgaatgaatgaggtgtttttattgacgtctataaaaagaaaacgcgcggaattactgcaatcatgccagtccgtattcaggtgtccgctatgcagttcggccatggcggtctcacaatacaaaagcttgatgtgcggacacgggcatacatttgatatatcaaagcaaggatatgtgaatttcctcaataaatcggtcaaaacccgctatgacaggcagctgttcgaagcgagacgcgctctttttgacagccgggaattttttgggccggttcaaaaggagatcgccgccatcatcagccgcattcaatctccgcaaacaacggcggcgatattggatgcgggatgcggagaaggcactcatttagccgccgtatgcaaattgcttcagcccgctttttccgtgacgggaatcggcattgatctctcgaaagaaggtgtgctgcatgccgcaaaggccttcggggatcatttggtttttgccgtcgctgatgtggcggatgcgccgtttgccgacagctgttttgatgtcgtgatgtctgttttatcaccttggaattacaaggaatgcagcaggcttttacgaaagggcggcacagtcattaaagcggtgccgcggcgtgattatttgaaggaagtaagggaattcttcttcggagacagtcctcggcggaatgacaccgccgattctgcggccggacgattccaagcgggctttcaaacctttgagcgcaaacggctgtgttacacgaagaccttatcgcagcctgaccttgagcggcttgtgaaaatgacgcccttaacatggaaatgtactgatgaaagcatccggcggtttatcagccgaaaagcggcggatattacgatagatatcgatattttaatcggaaccggtcctctgtaaacagaaaagacacgctgatcgcgtgtcttttttttatttccagacttcaccggcaatgttgacgacatgacgcagtttcgcccattgctgttcttctgtgatcaggtttccttcctcagtggaggcgaatccgcattgcgggctgaggcaaagctgatccaggctgacatattgtgaagcttcttcaatccggcgtttaatcgcgtccttgtcttcaagttcgccatgttttgatgtaatcaatccaagcacaagctgaagatcagagcgtttgacatagcggagcggttcaaagccgccggagcgggaatcatcatattccaggaacaatccgtcaaggtcaagcccgtcaaaaatcgtttcagccgctgcatcatagccgccttcagccgtccatgtggattggaagttgccgcggcagatatgcatcgtaaccttcagatcgtcagggcggtccttgatcgcgtcattaatggaagcggcaaacagcttgcgcagctcatccggcgttgtgccgaaatcttcaatctgacgaagccccgcttcagataagaaaacggcccatgcggtgtcatcaagctgaaggtagcggcacccggcgtcatagaaagcctgaatcgcttttttatacgcttttgacacatcgtgctgaaattgtttgtaatcattctggtaggccgctttttccaattttccgcggaaaaacagcatattcggacttgggatggtcattttcggaacagcatcgccggcaatgctgtgcaggaatttataatcttcgagcatcggatgctgagaaaaatcaatatctcccgttactttaatgccgcgcgctttcgtctgtacgttgtgaaactgaatgccgctttcaggcgtaaatgcctcaaccccgtctaaattttcgagaaaatcaaaatgccaccaggcacggcggaattcgccgtcagtcacgacattgaggccggtttctttctgcttttccacgctgcggatgatttctctgttttcgatttcgcgcagctgttctgccgaaatctcacccgccgctctttgcaggcgggcttgcttcacagccgccggccgcagcagacttccgacctgatccgcgcgaaacggcgggttttttcttagaagagtatgcaatggttgttctgtgttttgctgtgacatgaacgattccttctttcctgatgaaatgaaatataaaaaaactcttccctcggatagggaagagcttgcgtccgcaaatctcaaccttatcttcaggatttagcaccattctgctgaacagcggttgccgggtatcatagggccagtccctccacctctcttgataaggaaatatgctatttttcagaataaactgtaatactcttaatcttagtatgttttctcatattgtcaatatatttcgataaatatttttatttgtcaccctcaaatagaatcatatctatcacgatggcgatcgcaagacaaagagcaatatcctcttccttttcaatctgcaaatgataggaatcgccccagctcatccatgatttggtgacggtcatccggtttgattttccgtctgtcacttgaaaattccggccccacacatcgccggtaagattccagccgagtccggaaatttcaaatttcggtttgaaaaacgtgactttcttgatgacttggcagacgggtttgccgctgacggaaatctcgtaacggggaacgagcgacatcagtttctgattgacgctggcgagcgtgcggccgtccaaatcagtcagcttcagttcatcaccgaatgaaaacagctttccttcaacattgtagacttcttttccgctttcaagaaacacttgaaaacgattcttaaacgtaaacattcgctctttgatgtaaaaatggtacataaaaaaactccttttttatgttttacgaaaaaaggaggcggaaggtttcatatcggccgggtgcataaaaaaaggctgccgattttgcggcagctgtcgtttttatgatagcggcatccggcgtttttgacggatcgcatttaaatcaatgatgttattcgtgtcggcagctgtcaccagcgggcttgtctttggcgttttccggcggttgtccttactgaaagagaaaacaagataccctgtcaaagcagcgaaaataagtagcatcattttacatacctcccaaaaaaagttttggtattattattgtacgaaaaaacaaacgaaaagtattcaaacaattgtcacttttttaaaaaataacgtcattttccgtaaaaataactatgggttgaagaaattttgctcttgttgtggttctatagattgtatcggctgatgaatgatgatcgtttatataactttattactattttttgtaagtgtctaattaactacttcggtgttttcgtttgccttgtgttattcagtaccctaaaaaaccttatgatatgcaaaataactgcttctaacagatgactgcgagttgacagcgctttctttatttttttaaagaaaacgagatgttatcttaaaaaaatcgtttgaacattttccgcagttttttaaaagggtttgattttgtctccagtacacgcgggtcttttaaggtttttttcaattctttcgctacagtccctcttgccatagtcttcactccttctttccatttcataccttatatacggaaagaaagaaggaaaggtttcatgtgaaagaaaaaaaccaaagcagggggctttggttttaagcgcgctcttcaaagagcctggcgatttcaacaatgacgtttaccgccttttccatatgatcgacggaaatgtattcatattttccgtggaagttttggccgcccgtgaaaatgttcggtgtcggcagtcccatgtaagagagctgtgagccgtcggttccgccccggatcggttcgataatcggttcgatgtcgaggtttttcatggcttgatacgcgacatcgactatctctttgaccggttcgattttttctctcatgttgtaatattgatcacgcagttcaagcttgatgctttccttgccgtatttggccgccagcgcatcggcggttttctgcatatattcttttcgttctgcgaagcggtctctgtcaaaatctctgatgatgtacgacagggcggcttcagaaacgtctccgtccatggaaagtaaatgatagaagccttcatacccttccgtatattccggcgcttcttctttcggcagcgcgtgatgaaattccatcgcgatttttgaagcgttgaccattttgtttttcgccgttcccgggtggacgctttttccgtaacaagtaagctttgcggcggctgcgttaaagctttcatattgcagttcgccgagggggcctccgtctatcgtgtaggcgaacgcggcgttgaagcggccgacatcgaatttgtgagggcctctgccgatttcttcatcaggcgtgaacgcgacccggatcgttccgtgcttgatgtccggatgtttgatcaagtacgccattgccgtcatgatttcggcaatgcccgctttgttgtcggctccgagcagcgtcgtgccgtctgttgtaatcagcgtctggcctttatagcgggaaagttccgggaattgctcaggcgacaggacgacattgagtttgtcattcagaacgatatcatgcccgtcgtagctttcaataatctgaggattcacattttttccggtaaaatcggtcgcggtatccacgtgagccagaaaaccgacagtcggcacgtctttatccgtattcgccggcagagtcgccatgacgtacccgttgtcatcgactgtaatttctgtcatgccgatcgactttaattcatctgccagcatgttggccaatgtcagctggccgggggttgaagggcagttttcattgttttcgtcagactgtgtatcgacttttacgtaagaggtaaagcgttcaatgatttcatttttcataccgtcatctcctttgtcttatcttaccatgcgcgggggagggatttctatttcacaacccgtttgaatcgagggctctgttttttacgcgaatgaaaataaattatgaagaaacgatgactaaacgattaaactttttggaaatggatgattgaggaagaaaaaaccgatataatatggtcaattcattcaataggggaggctttcttcatggcgattttagtgacaggcggagcgggttatatcggaagccacacatgtgtcgagctgttaaacggcggctatgacatcgtggttctggataatctgtcaaacagttcaccggaagcattggagcgtgtgaaagacattaccggaaaagggcttgtgttttatgaagcggatctccttgaccgtgccgccgttcaccgggtgtttgctgaaaatgagattgaagccgtcattcattttgcgggattaaaagccgtcggtgagtctgtggctgttccgctccgttattatcataataatctgacgggaacgtttattttatgtgaagccatgcaggcacacggtgtgaaaaaaatcgtcttcagttcttcagcgacggtttacggcgttccggaaacaacgccgatcactgaggattttcctttaagcgccaccaatccttacgggcagacaaagctgatgctggaacagattttacgcgatctgcataatgcggactctgaatggagcattgcgctgctccgctactttaatccgttcggcgcgcacccgagcggccggatcggagaagacccgaacggcatcccgaataatttaatgccgtacgtcgcacaagtcgctgtgggcaagcttgagcgattgcaggtgttcggcaatgattatccgacaaaggacggcaccggcgtgcgggattacatccatgtcgttgaccttgccgagggccatgtcaaagcgctcgaaaaggtgctgaacacaacgggcgccgacgcctataatctcggcacaggaagaggctacagcgttctggagatggtcaaggcgtttgaaaaagtatcaggaaaagaagtgccgtaccgttttgccgaccggcgcccgggagacatcgccgcatgcttcgcagacccggcaaaagcgaaggctgaattaggctgggaagcaaagcgcgggcttgaagaaatgtgcgccgactcttggaagtggcagtcctccaatgtgaacgggtaccaaaaggtgtaaaaagaaagagaccttcaaatgatgagggtctcttttgttatgatgattatttaattttcacttcaacatcgttgctgaactttaatttccaagtgcctttagagtatgcgtttttatccacttcaaaagcttttacgtcagtcactttaatgttcgggttcaagtcacttaaaattttactgttgtctacttttgtttctgttgcatagcttgaagaagcatcaatatctgaatcataagatgttcctttagaatctactaatttcgctcttggaatggagaaagagcttaacggcttgtttgaaacatttttaaccgtgtattgaacagctacgataacgccgccgtcagacgcttttttctcgacaaattgagagcctactgaatctcttttttccactttcgtaacagtaacttcagttttctcagtcttaacagtgtcaccgatgttatacagtttttctttagattccgcagcttttgaagacgcagttttagatgacgaagaaccgcctccgccgccgatgtttacgagaatgataataaccaccactgccagaagcaatgtgatgattttatgtctcatgaaaaagtttctctgatctttaccgcagtttgggcattttttaacgcctttagcgatttctttgccgcatgccttacaagacaccaggttgcctgccataatatttcctcctatgtaaactatttcttaaaaactacatactataatgcctgtaaaataacctatagtcaataatattttgagaaaaaaagtattttaatgattttttagtcatgtattttaaggtcctttttagtatcggcagatcgttcgcattttccataggtttaatgaaaaaagagtggttgaacatgttcgtgatttcccgtataatcttgaaagataatataaaaactgaacataaaaaacagtggttttctagggttccgcaatgctgaattggtctggaccgagagaaaacacacagcaggttcctgctgtgacacgttgggataaaagcccgggagtttctgctcttttaatgaagagtgctctcccgggcttttttgattttataaaaaagggagtgtctgggatgaaaaagagattgctggatgtgctgatgctgattattggagcttttatctttgctttggccgttaatttattcgccattccgaatgatcttggagagggcggggtaacgggaatcaccctgatcttgtactatgtgtttgaatggtcgcccggggtgacgaatatcattttgaacgggattttattgattatcggatataaatttttagacggaaaaacaacgctttatacgatcattaccgttgtcgccaactcactgtttctgcatctgacgcatgattggcactcgccttcacatgaactcattattaatactatttttgcgggtgtgtttgccggtgtcggaatcgggatcattattcgagtcggtggcacgactgcgggttctgccattttggcgaggattgcgaacaaatatctcgattggaatatcagctatgcgcttttgttctttgatctgattgtcgtcttcagttcttatttcatcatcggtgcggaaaaaatgatgtttaccattgttatgctgtacatcggaacgaaggtgatggactttatcattgaaggcctgaatacgaaaaaagcggtgacaattatatctgagcataagcacgaaatcgctgaacaggtcaacacgctgatggacagaggggttacgctgctgtcgggtaaaggaaattacacggggcagtcgaaggaaattttatatatcgtcatccagaaacaagagctttccatgctcaaaaaaattattaaaagctgtgatacaaaagcgtttgtcattgttcatgatgtgcgtgatgtctttggtgaaggcttcgtcgatatctctaaataaaaaggatccctctgccggcgcggagggtttttttcttatgccggcagaagcggttatatccgtttcccgggaaatagcctgaaagctgtttcttaaaacgaagtggatacaatcggccggacgttttatactgaaaatatgatagagcgatagaaaggagcgcatatgaacccgttattggcaatttacccgagggctgtgttgtctgatacgtgctgtacggcggaggatgtcttttgcttttatgatgagaaaaggcgggtctatgtcgccattccgaaggaggatatcaccccgaaggagaaactgcttctggaatcatttttgacgcccgctgaagaaaaaggcgttttttttccggagacggcggcagcaaagaggtggcggcgttttctgctggaagaaggtccggtgcctgatgtcaaggagccgcgtgtccgttttatccattatgacttattgggagaacgggactggggggcattcacagaagcgctgcgccatttctggccggtttcatatacagttgtccggacggggagggatcatggcgtgattgtggaggaagaaaagctggaagcgccagattcggatgacatcgcatcttttgtgaagattctcgaaggcgatttttatttcagtgtccgttttttcgtcggaaggtattactgcaagggggaacgtctgcgccttcattatcagagagaacagcaatattgtcagatcggccggcgtcatctcccgcagctgagcacgctgaccgcggaaacggtatttccggccatgctcacggaggaaagcagagaaaagctctcagccttgcttcacgaagaagcggcgctgctgtttcagaaagaaccggagctgaagcatacgattcagacttttattgaacataactcaaacatgtcgctcacatcgaaaaaactgcatttgcaccgcaacagtcttcaatatcggattgataaatttgcggaacgctcaggtattgatattaagacatatcggggcgccctgctggcttatttcatttgtctgcaatatgaaaaatcacattaaatgggaaatgtgcacgaagacagcggtctttttttatgaacattgcctatatccgccgccgtctgacgctgttacaatcctatttaagaaagcgtttacaaataaagggggatatacatggcggaacttcggctcgagcatatttataagtattacgatcaaaaagaagcggctgtcgatgattttaaccttcatattaaagataaagagtttatcgtgtttgtcggtccgtcaggttgcggcaagtcgacaactttgcggatggtagccgggctggaagacattacgaagggcgatttctatatcggtgacacgagagtgaatgacatcgctcctaaagacagggatatcgccatggtgtttcaaaactatgcgttatatccgcacatgacggtctatgataatatcgcattcggtctgaagctgaggaagatgccgaaaccggagattaaaaaacgtgtcgaagaagcggcgaaaatgctggggctcacagagtatctgcaccgcaaaccgaaggcgctctccggcggacagcgtcagcgggttgcattagggcgggcgattgtcagggacgccaaagtgttcttaatggatgagccgctgtcaaatctggacgcaaagcttcgggtgcagatgcgggcagaaattattaagctccaccaaaggctgcaaacaaccacaatctatgtgacgcacgaccaaacagaagcactgacgatggcgacacgcatcgtagtcatgaaggacggaaaaattcagcagatcggcaccccgaaagaagtgtatgaacatcccgaaaacgtatttgtcggcgggttcatcggttctccggcgatgaactttttcaaaggaaagctgacggacggcgccattcagatcggttcagccgctctcagcgtgccggaagggaaaatgaaaatgctccgggaaaaagggtatgccggcaaagatatcatcttcggcatccgcccggaagacatacatgacgagctgattgtggtagaatcttataagaattcatccatcacagctaaaatcaatgtcgcggaattgcttgggtcagaaattatggtttattcccggatcggggatcaggattttatcgcccggattgacgcccgccatgacattcgtgccggtgaggaattgaccgtcgctttcgacatgaataaggctcacttttttgacagtgaaacagaaatcagaatccgctcataacgcaaagccggacagctggatgtccggtttttttgatgtaacaatttatgacgcataaccgatataaaaagtaaatagaagacagaaagcaggaaaacgatgaaacgcatgatcatgtgcatgtgccttttggctgccgtgtttacacttgccgcctgctcgggtcatgaggcaagcgccgaacaaagcattccgaaggcagaagcgcacagcgaaaaaaagtccgtaaagcggcaaatcaaaaaagagccggatacgtccgcctgggttcaaacgaaagggatggcgagactgccgattctgatgtatcacagcatttcagagggaaacagcctgcgtgtgccgaaggaagaattccggcagcatatgaagtggcttcatgatcacggctattatacgatgactcctgaagaggcctatctgatgctgacggaggataaggagccgcgtgaaaaatgtgttctggtcacatttgatgacggctatacagacaatgtgaaagcggcctatcccattttaaagaaatacaagatgaaagcgacaatctttatgatcggaaactttatcgggcataagaatcatctgactgagaagcagatgaaggagatggccgcccacggcatttccattcagagccatacgatgaaccatctcgaattgaacgggctcacaccgcagcagcagcgacgtgaaatgaaggactctaagcgtttatttgatcaaatgttcgggcagcggacgtctatgatcagctaccctgtcggacgatataataaagaaacattaaaagccgccgcctcgtcaggctaccgtatggcggtcacgacggagccgggagcggcgtctagagatcaggggctttacgggcttcaccgcgtccgtgtgtcgccgggcatgtccggcgcggcattcggctcttatattcaaaatgtgatgaaataacagagcctccgcatatgcggaggctttttttcagtttaatagaattgatgaagcagcagaagggtgacgctcacggtaatcgctccgccgattctggtcgacacttgggcgaacggcataagctcaagccgttcagcggcgctcaagatcgcgacgtcgccggtgccgccctggccggaatggcaggcattaataaccgccgtttcaatcgggtacagattcagccattttccggtcagaaaaccgacggccatcatcgtgacgacgattgataaaatggtaatgatgttgctgattgtaaacgccgcaatcagcttgtcccacggtgtcattgaaacgccgatcgcaaataagagcggataggtcacggctgtcgagaaaaagcgcgagacgccgaaggctccgttttcaatcgaagccggcgccagcctgaacagcttaatgagaacggcaaggacgagcatcacgactggagccggaagctgaaagaaatcatgcgccagcatgccgaccaaataaagggaaaccgctaaaataccgcccgaagcgaaaaaggacaaatcaaacgttttatcatcggccggctgttccaatgcgggagcggaatgatcagacttatcaaccttcccgttgcccgtccattccggtttgcgtttcccgatgacattcagcaaacccgataacataatggcgcacaggctgccgagcatgatggacggcagcacaagcgcaaaggcgtctccctgggacatcggcataatatcggagtagccgatggataaaggaatcgcgccttcaccgacaccccccgccataatcggaacgacgatataaagcagcgtgtgctgaaagccgagcccgagcagcgtcccgacgcataagccgacgatggcggccgcgatagacccggcgatcagcggaataaaaatcttaacgaaagctttgacgagcgtctctcttttcatcccgagaatactgccgacgacgataccggcaataaatagatagagaaagttggagctttccgtgaattctgttgttgaagtaataatgtctttcggaagcaggtggtagtagacgacagcggatggaataaaggttgcgagaatcgcagggccgccgatggaccgcacgatcggaatggattttccgatctggccgaaggtaaatccgaaaaaactcatgacggcaattgatgtcagaatgtcgctttttacatcacggctcatgacaaacaccgtaataagcaagaaaagcaggatatagataggaagaggaataatgccgattcttatattcattgctctggcaaaccagttatcagtccgttcctgtttttggattgaatccgtttgcaattttggttgaagttctcccatgcttgttcccccagtcgttatgtagtgaaaaaatatccccatttaaagtatactaaaaaatttaaattgttcatatattatgaatttactagaggacatgctttcttcacattttctttctcaaaatggcgatttggcgggctttttcaccgagaaaagcattttgttcgccacacgaataaaaaagaggtacgatatcaaagggacaaatatcctaggtgctgacataaaatctctacaaatccgacaataatcagtcacaatttcagcctgattttaggtatattgatctttttttttgggctgaatcgttgtaaagtaatgatattgaatcatttctatgacagccgctgtcccccagggtgtacaggctgatatttcaatagttttgacgaatttgtgaaacattgagcaaatatatcattttttgtgaaataccgagcaatgatttcactatgtttgtgaaatgttgagcaatttaccagattggaggaaaaacatcatgagtgagttggtattagcccgcattcaatttgcatctacaacattgtttcacttcttgtttgtgcctatgtctatcgggcttgtgtttatggttgctttgatggagacgctttatgttgtcaaaaaacaagagacctatctcaaaatggctaaattttgggggcatctctttttaattaactttgctgtcggcgtcgtcacagggattcttcaggaattccagttcggattgaactggtctgattattcccgttttgtcggggacgtatttggggctccgcttgcgattgaagcgcttttggcgttttttatggagtctatttttatcggattatggattttcggctgggaccgtttatctaaaaaagtgcatttgctttgcatttggcttgtatccttcggaacgattatgtcatctttctggattttgacggcaaactcattcatgcaggagccggtcggctttacgattaaaaacggccgcgcggaaatgaatgacttcggagcgcttttgacaaaccctcagctttgggttgaattccctcacgtcattttcggagcgcttgcgacgggtgctttctttatcgccggtgtcagcgcatttaaattattgaagaaaaaagaagtgcctttcttccataaatctttcaagctttcgatgattgtcggtctgatcgccggtatcggcgttgcgttcagcggacacatgcaggctgagcatttaatggaatcgcagccgatgaaaatggccgccagtgaagcgctttgggatgacagcggtgatcctgccgcgtggacggcttttgcgaatattgatacgaataaagaaaaaaacacatcagaaatttcaattccttacgcactgagctacttggcttaccagaagttcagcggcagtgtgaaagggatgaaaacacttcaaaaagaatatgaaaaaacgtacggaaaaggcgactatatcccgcctgttaaaacgacgttctggagtttccgcattatggcgggagcgggtgcgcttatgatttttgccgcgattgcaggctttattctgaaccgccgcaaaaagcttcatacgagcaagtggtatttacggggcatgatcgcactgatcgcattcccgttcattgcgaactctgccggatggattatgactgaaatcggccgccagccgtggacggttatggggcaaatgacaaccgcacaatccgtttcgcctaacgtaacgacgggatctctgctgttttcaattatcggtttcggcgtcatgtacttgattttaggcgcgctgcttgtcttcctattcgttcgtgaaattaaaaaaggtgcggaccatgatgatcacaaggatgttcctgtatcaacggatccgttcagtcaggaggtctaccatggggtcacttcatgatctttggtttgtactcgtttcagttttgtttgtcggatttttctttttagaaggttttgatttcggtgtcggcatttcgacccgatttcttggccataatgaattagaacgcagagtgctgattaacaccatcggcccgttctgggatgcgaatgaggtatggctgctgacaggtacgggagcgatcttcgcggcattcccgaactggtatgcgacgatgctgagcggatattatattccgtttatcatcatccttcttgctttaatgggccgcggggtggcgtttgaattccgcggaaaagtgaatcatttaaaatgggtcaaaacatgggactgggtgattttcttcggcagccttatcccgccgtttgtattcggccttatcttcacaagcttgttccgcggcatgccgattgacggccatatgaatatgcatgcgggtttctcagatattgtgaacgtgtattccgtccttggcggagcagccgtcacccttctttcattcctgcacggtttaatgtttgtcacactgcgcacgatcggtgatttacaagagcgtgcgagaaaaatggcaaaacgcgtaatcggtgttatctttcttgttgtacttgctttctttgcgatgtctgcatacgatacggatatgtttacacgccgggcaaacatcacgattccggtattcgtgctgattgtcatctgcaacgttcttgctgttgtgttcatgagcaagaaaaaagacggctgggcattcggtatgaccggcgcgggtcttgctttgacagttgcgatgatttttatctctctgttccctcgcgtcatggtcagctcgctgaaaagcgcgtatgacttaacagtagctaacgcgtcttccggtgattattcacttaaggtcatgacaattgttgcactgactctgctgccgtttgtcatcggcagtcagatctggagctattatgtcttccggaaacgcgtcagccataaggagcctatgacttattaatgggaaaagacctgtttctttataaaggaatgaagcggattcttgcgatcattacgggattaacgattatacaaacggccgccatcatcttgcaggcggaatggctgagccaggcggtaaccggattatttaacgggaagcggattgcttctctttatccggttatcggctttttcctgcttgcgtttttggtccggcatgcggtaaccgcggtccggcagaaaatcgtgtaccaatatgccgcgcaaaccggcgcagacttaagaaaaagatttcttgagcaattgttccgtctcggcccccgctttgcgaaaaaagaggggacgggccggatggtgacgctggcgatggaaggcatcagccagttccgccgttatttagagctgtttctgccgaaaatggtcagcatggcgattgtgccggcggccgttgttatttacgtgttttttcaggataaaacatcggctttgattctgattcttgcgcttccgattttgattgtatttatgatcctgctcggacttgtcgcacagaaaaaagccgatcgccaatggaagtcctatcagacgctttccaatcatttcgtggattcgctccgcggactggagacattgcggtttttagggttaagcaaatcacacagtaaaaacatctttcatgtcagtgagagataccgcaaggcgacgatgagcacgctccgggtcgcgtttttatcatcattcgccctggatttctttacgatgctgtcggtggcgacagtggctgtgtttctcggcctgcggctgatagacggacaaattctgctcggtccggcattgacagcgctgattctcgcgcctgaatattttctcccggtccgcgaagtgggaaatgattaccacgcgacgttaaacgggcaggaggcggggaaaaccattcaagcgattttggcgcagcccggttttaaagaagaaaagccgctcgaacttgatacgtggactgacggggatgaattacagcttacgcgtttgtccgtccgagaatcgatgtctgaatttcatctgtcctttaaagggaagaagaaaatcggaattatcggggaaagcggtgcgggaaaatcgacactcattgatgtgctgggcggctttttagagcctgcgtccggtgagatcaaggtaaacggtgaatcccgctcgcatctgcagtcagacggctggcagaagcagctgctttatatcccgcagcatccgtacatttttgatgacacgcttatgaataatatccggttttatcatcctgatgcttcccgtgaggaaacggcgcgcgctgctgattcagcgggtctttccggactgatccgcgatctgcccggcggccttgacggccggatcggcgagggcggacgggcgctcagcggagggcaggctcagcgtgtcgcgctggccagagcctttttaggaaaccggccgattctccttttggatgagccgaccgctcaccttgatattgaaacagaatatgaaataaaagaaacgatgaaagacctgtttgaaaacaaacttgtctttctggccactcaccgtcttcactggatgcttgagatggacgaaattatcgtgcttgatgacggcgcggtggcggaaatcggcacccacgacgaattgatggcgaaacaaggcgtatatgccaaacttgtaaaggcgcaactgggggaaagaacatgagaaaagaagaatggattctgccgtatataaagcaaaatgcccgtttgtttgttcttgtgatttttttaggcgcggtgacgattttttcggcggcctttctcatgttcacttccggttttttgatctctaagtcggcgacaaggcctgagaatatcctgctggtgtacgttccgattgtggccgtgcgcaccttcgggattgcccgttcagtctcacggtacgccgagcgcctgacggggcaccatatcattttgaaaatcgtgtccgatatgagggtgcggctttacaatatgctggagccggcctcgctcatgctttcatcccgttttcggacgggcgacatgctcggcattttggctgaggatattgagcatttgcaggatgcgtttttaaaaacgattttcccggcggtttccgctttgctgctgtatgcggcatccgttatcggactcggctttttttcctggccgtttgccgcttttgcggcgatttacctgtttatattggttgtattgtttccggttgtgtcgcttcttgtgacgagagcgaaaaacatgaggctgaaaagcggccggaatacgctctacagccggctgacagatgccgtgctcggcgtgagcgactggatgttctcgggacgacaggcggcctttatttcctcttatgaagagaaagagaaggcatggtttgaccttgaaagcaaacgtcagcggtttacgagatggcgtgatctcgccgcgcaatgccttgtcggcggcttcatattgatcatgctgttctggacggcgggtcagtatgcggacggcagcatcgccaacacgatgatcgcagcctttgtgcttgtcgtatttccattgacggaggcgtttctgcccctttcggatgcgctgacggaagtgccttcttatcaggattccatcaaaagaatgagtaaggcggctccggagctgcgaagtcgtgaggtgaagcagacagatgagatactggatgtatccgatgtgacacttacatttgataacgtgacgttttcttatgatcagcacagtcatgtgcttgaccgtttttccttcactctccgccagggggaaaaaatggcgctgctcggcaggagcggctccggtaagtcgacctctctcgctttaattgaaggcgccttagttcccgattcgggcaaggtgatgctgaacgggctggaaactgcggccgtgcaggagcagatttcctcagcggtggccgttttgaatcagaaacctcatctctttaacacgagcattatgaacaatatccggctcggaaacggcaaggcgagtgatgaagatgttaagcgtgcggctcggcaagtgaagctgcatgattatattgaatcactgcctgacggatatgaaacgtccgtgcaggagacggggattcgtttctcaggcggggaacggcagcggatcgcgcttgcccgtattctgctccaagacacgccggtcattatccttgatgaaccgacgatcggccttgatgcggtcactgaacgagaattgcttgatacgatttttgatgtctttaaagagaaaacgatcctctggattacacaccatttagcgggtgtggaaacagctgataaaatcgtctttttagaaaatggaaaagcagaaatggaaggaacccatcaagagctgcttgcagaaaacgaacggtaccggaagctttaccgtcttgatgttccgatcagaacataaacagccgcaaacgagcggctgtttttttgtgcggtttaaaatctcttcttgtttggaatataaataggagacagaagaggaggtacagagatgaatataatggattggacggaacaggatgtgaaagatacgctgccgaaacgggaggcggacagccataaaggcacgttcgggacggcgttattgctggccgggagcgatgacatgccgggagccgcccttctagccggattgggtgcgatgagaagcggtgtcggcaagctcgtcatcggtacatcggcaggcgtcattccgcttatcgtcccggtgctgccggaagccacgtactggcgggacgggtggataaaagccgcggcgggccagcccggggaaaccatccgggccgctgccatcgggccgggccttccccaaacagacgaggtgcagcaggcggctgatcagctgctttctggcgattatcccgtcatactggatgcgggcgccattacgaaaagaacctatccgaagaggaaagctcccgtgatcttgacgcctcatcccggcgaattttccagaatgacaggccttccgattcaagagattcagcagaacagagcggaatatgccgcggaatgggcggagcggcttcatgtcacgattgtcctgaaaggaaacgaaaccattatcgcttttcccgacggggaatgccgcaggaatacaaccggaaacggcgcgcttgcaaaaggcgggaccggcgacacgctgtcgggaatgattctcggcatgctgtgctgtcatcaagacccgaagcacgccgtattgaacgccgtccgccttcacggcgaatgtgcggaattatggacgaaagagcgctccgcccataccttattggcgcacgaactttctgaactgctgccgggtgtatggaaggaatatgaataaagaaaaggcgtcttcatagggaaggcgcctctttttgttttaaccttgatttcatcaggacataatacagcagcgacggaacggccaggccgatgacccaggcaatgtcgcctccgccgaatatttcagcgagcggcccgatgtaaaaggatgtattgatgaacgggatttctaatataatcgacaaaacgaaggcggccgctgtaatccaattgaccctgccgtattgtccgttgacgtcaaacatcgatttgacgtggtattttccgcggcggataaaatagtaatccacgaggttgatcgccgtccatggaattaagaaataactgatgaaaaagatgaaatttaaaaacagttccatgaaattgctttggcccaagagacttaatacagtacccgctgccgtcacacaaaggatcattaccactctcgttttcggcgtcaccttcagttttaaaaacggctccaaggtagtcgtggttgacataaaggctccgtataaattaaagacgttgatcgccatttgcccgaacaggacgatgatcagcataataaaggaaaacggaccgaacaatcggacaatctcatttcccgcattagcggtaaattccgggagcgccgtcgtcaaaatggcgccgagaagcatcatccagatggaactgactgacgtacctgcatagctgtaccaaaaagtatgcgatgccggtgttttgaccggcagataacgggaataatctgcgacatatggcgcgtatgccagctgccatgtggccaccgcgctgaccgccactagaaaaacaggcagatctaatgagccgggcacccagcttcctgaaggaatcggcagttgaaaaataagaatcgttgcagcaaaaaaaacggcaaaggaggtccaagagaggattttctgcattttgtgaatcagatcatgaccgtagatcgtgagtaaaaaacagatggcgcttaagccgataatacaccatgaagccggaatcgggacaaagctgctcagtgtaccggctgcgagaatcgtactgctcgcaaagaagcccaggtagataaacatgaccaaaaagagggcagaatcgctccgatcacgccgaattgcgcgcggctttgaatcatttgcggaattccgagctgaggtccttgtgcggaatgagacgccataaagattgcgccgataaaggttccgatcacaatggcggcgatactccaaaagagatcgagtcccattgtaacgggcagtgtgcctgtgactaacgtcgtaatatgcatattagccccgaaccagacggggaataaatctttagcctttccgtgtctttcgtcatgcggaatatgttcaatcgttcgcctttctactttcaatagataatctcctccgtatgttcttctttaacataaagacatagcttaacagattgacctgccgtttacaaattccagcatgcaggaaaaacattgtaaagcctcgctgacagccgttcaaagttttttgaaaaacggaacaaacactgccgcctaaacgatttaccagggattaaaaggtatggatatgcttactgactaatatgtatgaaggagaaatgtgtcaatcttttgacgaatggagccattattcgttaagctgaaagaatagtttactttgtgtaaatttcattaatgaaaaggggattgatgatatgtgtacaagtcttacattgaaaacgacagacggcaatcacctattggcgcgaacgatggattttgcatttcagctcggtacggacgtcgtgctttaccctcgtcagtacagctggaaaagcgaagctgacggcaggatgcataagacgaaatacgcatttatcggcatggggagaaatctcggcaatgttctgtttgccgacggcgtaaatgaaaaagggctgtcgtgtgcgacgctgtattttccgggctttgcgggatacgagaaagcggaacgggagggcacctgtcacatcgctcctcatgagtttgtcacctgggccttatcaaactgtgaatctcttgaagacataaaggaaaagctctcaatgctgacgattgtagagaagaagttaatgttattggatacggtgctgcctcttcattggattttatcagaccgcacgggcggctgcattgtcatcgagccgacaccggagggaatgaaagtatatgacaacaaacccggagtgatgaccaacagtccggaatttccttggcatgtgaccaatctgcgccattatatcggaatcaggccgcagcagtcagaaagcaaaacattgggcggaatgacattaaccgctttcggccaaggatctggaacgatcgggcttcccggtgattacacgccgccatcccggttcatcagagccgcttatctgaaagagcatttagagcctgccgctcatgaaacggatggcgttacggccgcttttcacgtgctgtccaatgtgaatattccaaaaggcgcggtgatcacagaggagaatgaaattgattatacgcaatatacgtcggtcatgtgctgtgacaccgggaactactactttcatctgtacgacaaccggcagattcacaaagtaagtttattccatgaagatcttgaccgtccggagccgaaagtatttgcggccgcggcggagcagaatatacaggagctgaattagctcaaaaaaaaaacaggacgcgattgtcctgtttttttatttaatacggatcagacggatggctttcctgttcagcctgttttgcggcttgtgctgtatcagtagtgccgatcggcccgccgctgctgctttcggaggcttttttcagcccttccgcaacacgttttccgtagtccggatctgcttttgtgaaattctcaatcatttgatcctgaatgtctttccggcaggaagaaagcgtattgaccaggtttgtgatcaattcggtccgttcaaattccgaaaatctgcggtatgtttcaccggcctggccgaagttattcggccggtcgatcgcttcccgcttcacatcgccttcgacatgaggtgtatggtctttcccatcctgctttgcttcggtgagtcctcccataatggacggctcatagttgacgtgcgggttttgtccttctgcccgatcgacccgatactgcatttgcccgccttcctggttggtggcgacatgctttttcggcgagttgatcgggagctgcaggtaatttgcgccgacgcggtaccgctgggtatctgaataggcgaatgtccgtccctgaagtaatttgtcatctgaaaaatcaaggccgtccacaagcacgcccgttccgaatgatgcttgttccacctcggcatggtagttttccgggtttttgttcagaaccaatttgccgatcggcttccaagggaaatcgtctttataccacagcttggtcggatcaagcggatcaaaatccagctcgggatgctcgtcatcagtcatgatttgcgcatacacttcccattcagggtaatcgcctttttcaatcgcctcatacaaatcctgtgtcgcatggttaaagtttttcccctgaatctcttccgcttccttctgtgtcaggttgcgtatgccctgtttcggttcaaagtgatatttgacgagcacggcttttccttcttcattgacccatttgtaggcatggacgcctgagccctgcatctgccggtagttggccgggatgccccacggcgaaaacaagaaagtgatcatatgagtcgcttccggtgattgggaaatgaagtcgaaaatacgctcgccgtcctgaatgttcgtaacgggatcaggctgaaatgcgtgcacaagatccgggaacttcagcggatcacggataaaaaagattttcaggttgttgccgaccagatcccagttgccgtcttcggtataaagcttaacggcaaaaccccggggatcacgcaatgtttccggggaatgcttcccgtggttgacggtagagaaccgcacaaacgccggagttttcgttcctttcttttgaaacactttcgctcttgtatatttagaaatctcctcgtctccaaaacttccgtacgcctcaaagtatccgtgtgcgccggcgccgcgcgcgtgaacgacgcgctcgggaatccgttcgcggtcaaagtggctgattttctccaaaaaatcataattctccaatgtcgtcggtcctctattgccgactgtcctgacattctggttgtcagtgaccggatggccctgccggtttgtcagcgtgtcttctgactcgcctttaccggtcgtcttactggaaagcgtttcttcgctgtttttgttattttccattgttgaaccctcctttttgaacggtaacaatatgcccagcagagccgttttttaaaaccgattttcaaaagaagcggttattccgcgatcggcgtcaaggacccgccgttccatatttcgcccttgttcagcgtccagctgttttgataaaggctttgcgcgccttgattggccgccggacttaattgttcatcccatgtcaaaaagtacgcggtctgagggtatttttgcctgatcgcattaataaaagcagcataatcaaagcttccgatattgccggacggaccggtttcggcaaaggcaaacggttttttcagagacagcatttcatcatagcctgatatcgcatacggatcagtgaagtaagcgtccagaccggtaatatccacataagatgagcctgggtagaagtctgttttaaagtctctgttggcatccggcgaatacacccacaaaaggttatccaatcctcttgtctctgtcatatagcggtatatcttcttgtaaagctctttgtacagcgagattctctcattgtctttttggttgtagcctgtcagcccccaccagaaccactcgccgttcatttcatgcagcggtctgaacagaacggtgacgccttgatttttcagctgagtaaggccgtcggcaattttgctgagcagcgcctcaagccgttttccttccacagttgaagggtcaaggatgtttttgtactggctgtttgagatggccgttttatagtttccggatggaaaggccggatttgcgagatgcaggctgacctgagggaggccgccgcttttccagtatgagattaagctgctgttgcagctgtaatcgatagtatcggtgatatccgctgtttccagccaccctctcccatagtcacagccgtagatggcgggagactgtcccgtcgcgtttttcaagcggttttcctctgtcattgaaaaagtgacatcactgtacccgccgaacgctccggacatgaccctgttttctgaacggttgggcaggtgggccagccagttcatgatatcttttgtcgtctgctgggcatttgggttgacgggataaacggtgtgagccgatatcggactggcggctcctaagagtaataaaacgatagacaggcagactgctaactttttaagcatataaaagacctcctgatttttaagatgatgaaggatgtgaaacgataacctcacaatctccttctataacaaaatctccggaatccgccggcacgataaagtgatcgcctttctgaacggggcatccatccagttctccgcgccctttaatgacgcttgcgagtaaataccggccgggtgcggggaatgatgctttcccgctcacatcccattgataaactgaaaagaaaggtgtttcggcgagtatcgtaataagagcatctccgatccgatgcttagtgctttttacattttcatcggtatggggaatgtctgttacgtcaattgctttctcaagatgaagctcgcgtttattcccgttcccatccgtccggtcatagtcgtaaagccggtaggtggcatcagagctttgctggatttcaaggacgagcgtaccttcacataaagcgtgcagtgtgccgctcgggacatagaaaaagtcgccgggcttaatggggatgcggcggagcaggtgatcccactcgtttcgttcaatgagccgaacgaaatcttcttttgtttgggcgcggtgccctaaaatgagctccgcgtcttttttgcagtccaacacgtaccagcattccgtttttccgagttctccgttttcatgccgatgtgcatatgcgtcatccggatgaacctgcacggataagtccatatttgcgtcaagaatttttgtgagcaggggaaaagcttcttctttcggatgtccgaacaggtcagggtgttcattccagagacggtgtaatgatgttccggaaaatggcccgttccgcacgatggatgtaccgtgcggatgagctgaaatcgcccagcactctcccgtccgctcagaaggaatctcatacccgaatgtatcgcgcagcttcgtcccgccccataatctttctttaaaaaccggttccaaaaataagagtttcgtcattttcccgcctcccggtttgccgtctctaatgcgcgctccgccaatacgagcgaaccggccgcgccggagtgaatccctaattgagggggaccgatgaagtgttcaatgtcgggcagatcaatatattgattcagccgctttttcacgtgctgacggatataagagaacagctgatgctgcttcatgacgcccccgccgagaatgatcttttccggcgaaagtatgagaatatactgcacaagcgcttcggcaatataatagccttcaagctcccacacttcctgctgatccgccagcagatatgcttttttcccccagcgtttctcaatggcgggacctgccgcgaggccttccaggcaatctgtatggtaagggcaattgcctttgtagccgtcgtccgggtgtcttctgacataaatgtggcccatttcaggatgagacagcccttgaacaaatctgccgttcatgatggcgcccgctccgatgccagtgccgaccgtcaaatagaggcagctgtccgcgtttttggccgcgccgaaagaagcttctccgagcgccgccgcattaacgtcggtggtgaagcctgcgggaatatgcagtgcgcttttgatcgtttgaagaatagggcagttccgccaggctgtcttcggcgtcgcggtgatgcacccgtatgtttgactgtcggggcggatgtcaatcggtccgaacgacccgatgccgatggcttctatcgggaaatctttaaagtaacggatgacttgtctgagtgtgtcatccggttctcccgtcggaaactccgccctgtccagaatggtgccgtctttttgtccggcggcacagacaaatttcgtgccgccggcttcaatacctccaagcatggctgtacctcctcatctgttaaaatccgttttgatcggaaacggctttgaaccagcggccgctttttttgacggtccgttcgcccccgttttccagattgacagatacaaagccgtagcggtttttataagcatttgtccaagaccagttgtccataaaagtccacaggtgatagccttttacatttgaaccttctccgatggcccgatgcacccatttgagatgttcccggataaattcaatcctgtaatcatcctgaatgatgccgttttcatcgcggaagcgttcctcgccttcaactcccatgccgttctcggaaataaaacattcgatatttccgtaatgttctctgagattggtgagaatgtcatagattcctttttcgtatatttcccacccgcggtgtgggttcattttccgtccgggcataacatacggatcgaagaaacgctcaggcaggaaaggggcgtgcggattcggaacatgttcttttgccttgacgcgtctcggctggtagtagttcacgcctaagaggtcaaccgtatgctcctgaatgaggcggagatcttctttctcgtaacgcggcagaaagccttccgccttgagaatctcgacaagctcctcaggaaattcgccctttacggcgggatctaaaaatgagcggttgaaaaaggcgtcggcaatccgggatgctttcagatcttcagggtgtgagcttctcggataagaaggcgtcagattcagaatgattccgatttgtccgtcctgtttcaattctctgtaggctttgacagcccttgcattcgacagcagggtatggaagccggcctgcaccgcttcttgaaaattaacgtgattcggatagtgaaagtcgtataagtagccgccttcaatcggcacaatcggctcgttgtgagtgaaccattttttcactttgtcaccgaatagcgaaaagcatgttttggcgtaatgttcaaacgcgtcaacggtgtcccggctgacccagccccccttacgctgaagggcgagcggcatgtcaaagtgaaacaaattgacaaacggctcaatgcgatgggcaagcatttcatcgatgacgtcctgataaaacgcgaccgctttctgattgacctcgccagttccgtccggaatcaatcttgaccaggaaatagacagccggaaggagttgtggccgatttctttcatcagccggatatcctccttgtattgatcataaaaacgtgacgtgtcgccggggccgacgccgttaaaaaaacggctcggctctttttcataccagtaatcccatatgttttggctttttccgtctttgtcggcggcgccttctgtttgggtggcggaggcggaagacccccaccagaatccttccggaaaacgatattgaatatttgattcagtcaattgatttctctcccttactgcgattttgattacatactcatgctgtcatcccgtgcttgctgctcggcctcggcttctttttcctttgccatgtttaatttgtccagcgctttaagaaacgggaaccagataataaacacaatacagaggttgaccagctgcataatgccgcccatgacggaattggtcgccataatcccgttaatgaaaagggggacggtccagggcacggtcacgccagtaggagggggcacgatccccgccgacatggccaggtaggtgacgagcgtgacaaccatcggtgcgatcacccacggaatgataatgatcgggttcatcacgatcggcaaaccgaaaataaccggctcattgacgttgaaaatgcccggcgcgagaccgagtttggatatctgtttcatctgtttgcttttcataaaaagcaagatggtgatcactatggccaatgtcattccggttccgcccattccgacggtgtaaatctccataaacggcttagaaataatatggggaatctcttttcccgctgtatacgcagccaaattttcgacctgtaatgtattccagatcgggtccatcacggaattgataatgatctgtccgtgaagtccgaaaaaccataaaatctgaataaagaaaacagcgattaatgtaggaatgatgccgcttccaagtccgacaagcggggcttgaaccgtatgataaatgacatcatgcagattggtgtgaaagatctgggtgacagccgcattgatcaagaggaagacggtaagcgtgataaaagccggaatcaatgcggcgaacgatttagcaacagccggaggaacaccggcaggcatcttaatcgttaagtttctctggacgattcttctgtagatttcacccgacaaaaaagcggttatcatgccgagaaacatcccttttgctccaagccggtcaaccggaatgacgcctgcgaccgctttgcccgtttccggctctaagacgaacggggtgagcagcagaaaagaaaccaatgcaatcgctccgccgaatacggcctccacttcgtagctttttgaaaggtaatagccgatcccgaagacgacaaaaatggacataatccccatcgtcgccgtcgaagcgccgccaaatccggattgaaagacagacagggcggagctgctcatgattttgtttaaaaacggcaggttcgtcagcacgacgaacaccgaaccgaaaatggtcagcggaaacgccagcataaaagcatcccgtaagacttgcaggtagcggttattgtttaatttgcccgcgatcggaacaaggaattggctgattttctcaaacacgtcttcacccccggctttttataaattctttgattgaaataagtcgagcatttctttgacgatctctttcattgagagcgctgacattaagtggtcttcagcatgcataaaaagcagggagacatccgtcttggcgccgccggcttctttttgaatcatctgaaaatggatgtcgtgcgcttttcccagttcttcttcagcctttgtcagaaaggtgtctgactcatctggccggccgtctttataagcgcgtatcgattgaataatacagctgcgggcattgccgctgtgaagaatcagctgaaaactgatctgttcatccgtgtacgtttccatgcttatcgcctcctttatttgttctctatcaaggaaacggcctgttcgtatgcttttttgccgtctcccatgccgtatgccatcatatcaatcacatcaacggtgatgtgaagcgggtccgcctctttctgaagctcgccttttaaaaaactcatctgcgggccgatcagtacgacgtctgcgtctttcatcgcttcttttgctttatcctgtccgactgcccaaatctcggcctcctcaccgatggagctggcgtaattctgcattttcgtcacaagaaggctggtggacatgcctgagctgcaggctaataaaattcttttcatgaggaatcccttctttcataaagttaaaacgttttcatgaatattataatcttttgaaattaaatgtctatacttttaaaatataaaagttttacttttcggatttttgacacaaaaaaaccttttaagattcaacttaaaaggtttttcatctcaagcgagccataacagccataaataaagtccgatcagggtgatgaataacgtcggaatggttaatatcagacctgttttgaaatacattccccaggaaattttcacgtttttccggctcagcacgtggagccataacaatgtcgccagcgacccgatcggcgtgattttcggcccgaggtcagaaccgataacattcgcgtaaatcaatgcttctctcagcagcccgtgagtgtccgttccgttgatggctatggcgtcaatcatcaccgtcggcaggttattcataacggaggagaggatcgcagcgataaaacccattccgagtgtgcccgcaaacaatccgtgatccgccgctttctgaataagctgagaaagaagatccgtcagtccggcattccgcaagccgtacacgacaacatacatgccgacagaaaaaaacacgatggcccacggggcgtccttgatgacttgtttcgcagggacggcggggcttcgctgcgccagaatgagaaaaatgaccgcgatggagccggcaacgaaggaaacgggtatcgacagcagttcgctgacgaaatatccgatcaataaaacggccagcacagcccacgataaccggaaaaggcgttcatccttaatcgcggatgccggatgtttcacaagaccggtgtcataccgtttcggaatgttttttctgaaatagagatacagcaccaaaatgcttgccgccagagaaaaaaggttgggcaccagcatgcgtgttgcatattcaatgtacccgatatgaaagtaatcagcggatacaatattgaccaaattgcttacaacgagcggaagcgaggtggtgtcggcgatgaatcccccggcgataataaacggaaaaaccagcttttcaggtaaattcaaagcccgcaccatcgccagtacgatcggcgtcaaaatgagcgccgctccgtcattggcaaacagggcggagacaacagcccctaagaccgacacatagagaaacatccgcagcccgctgcctttggccgccatggccatatgcagcgcggcccactcaaaaaaaccgatactgtcaagaattaatgaaatgataataatggcgataaaggcgagtgtcgcattccagacgatccccgtcacttccgcgatatcgtgcaggctgactgctccggcgatcaaagcgaggaccgctccgccgcaggcagaccagccgattgatatatgtttcggctgccatatgacaaacacaagtgtcagcacaaaaatcagcgctgataaaaccgcaactcccaagaatatatcccccttaccggcatgtaacagtgacttctttttgccgcaatgtctgtaaaacttcgtccttttcatctatctgctgcagaatcgagcaaaccagcgcgtattccggtccggacggatgaatggcatagtaccgccactggccctcgcgtctttcgcgcacaaggccggcgttctttaatttccgtaagtgctggctgatgccgggctgacttatatgaaaaatagccgtcagctcgcagacacaatattccttatcctccagaagcttcagcatcaaaagcctcgtcgggtcgcttagaagtttgaggcactggctgatcccttcggaacttaaagcattatgccgccgttccatgcgctcactccttttttacactattatataagcagacatttatataagtaaacggcaatataaaaaaagccggtcttgcactttttgcaaaaccggctcatgtttatttttggaacagttttttcgcttcatccattgctaatttatttcccagtgccgaataatcaagccaaggctgatcggcaattttatagacatggtttgctttcacggccttaagccctttccagacagcgcttttttgcaattctttataggcttgctgtgacttgtcgtctctgttaacgaccacgaaaatcgcatctgcgttgtaatcaggcagcacttcttgagaaatgacttcataagggcgggaggtattcatttctttaatgccgtcagccggtttcagcttcagatcgtcaaacagaatcggtcccatcgggcggcgtgtgctgaagacgcgaagctcttttgcgttcacgcggatcgccatgactttggcgtttttccctaattccttattcatcatggatctgacttgttttgtttcatcttcgtaatcttgaataaatgttttcgcttctttttcacggttgacgatttttccgatgtcttttaaatgatcacgccatgtgcctttatcaaggtcgaaaacgtgtgtgtttccgattttcttgtatttagacacatcttttcccgcaaattctttatcaagataaatgttgtctggattcagctcaagtaaagcttccatatccgggtctgaggcaggtccgagttttttcgtgtctttcagctgatttttcacatgagggagaaaatcttttaattctccgcccacgacggaaccggcaggtgtaacgccgagagccagcagatcatttgtcaggtgaatggacatcgaagcgattttatgatcgccggatttcttttttgactccggctgtgatgaatcggattggcaggcagccagtaagaaaatacacatgaaactgatgagcgcaattatttttttcatgggaatactccttgttttatgatttgattttcatgacgagatagagaaaatacggcgcgccgatggctgccgcaaccacgccggccggaatggcgttcggctgaaacaaagaccggccgatggtgtctgccgcgacaagaatgacaaggccgattaatccagcaatcggaataatatgctgatgcatggtgccgacgagccgtcttgccaagtgaggggcggcaaagccgataaagccgattccgccggccatcgcgacgctcgcgcaggacaagccgaccgctatggcgatcagcatgatcctttttctctgcacgtgtgcgccgagccccgccgctgcctggtcaccgagcattaaaatattcaaagaccgggcgttaagccatgcaagcggtgcgagaatgccgatccagggcaaaagcgaccacacgtgaatccaatctctgccccagacgtttcccaccagccagcgggaagcgaaggtataagtttcttcattcaggcgcagcgacataaacaatgtaacggcgctgaagcccgcggaaacggcgatcccgaccaacagcatgcggatcgttaaaaaaccgttcagcctgtcgtacgtaagcactacgatcagcagggcggcgagtgttccgcccgcaaacgtaaacagcgggatgaacatcgacgcctgcgcctccagggaatgaaagaatgtgatatacatcatcaaaccgaaggaagcgccggcatgcagtccgagaatgcccggatcggcaagcggatttcgggatacaccctgcaaaatagcgcctgacacgcctaagccgataccggccagcatcgtcaccagtatccgggggagccggtaatcgaataaaacggttgtgctttgaaacgtgccgtaaccgaacagcgtttttcccacggtgaggggagaaagccggaatgagcccgtgtgcagcccgatcagaataatgcaaacggcgatgaccagcagaacgagacctgccgccgccgctttttttgtttctttctgcactttcatttataagtctctcccttccttgcgggcaatataaagaaagaaagggacaccgacaagtgccaccatgatgcctatcgccaattctctcgggggactgaccgtgcgtgaggccaagtcggccaaaatcaaaagaatcgcgccgagcaacgcggacatcggaataatcagcctgtacgtaacgccgacgatcttgcgggcgatatgaggaatgaccagcccgacaaagccgatcgcgccggcagcggaaacagacacaccggcaagaacgacggcgatcattaatcccgcggcacgcgtcagagccgtgttcacccctaaattcgccgccacgtcatttcccattgagagaagggtgacggaccggcccatgaatgtcgcgagaatgatgaagaccgcaatcacgggaacaaggacttgtaaatgagcccacttgatccccgacaccccgccggcgtaccagaaggccaaatcctggcttaaatcgtaataaatcgctacaccggtactgagtgaatgtaaaagcgcggccacgaccgccccggcaagcgtcacctttaaaggtgtcatgctgccttttcccgccgcactgataaagaaaatcaagccggtgcttgccagtgctcccaaaaatgacatcatcatcagcagggcgtatgacaaatgagggaaaaaagcaaagctgagcgcaacaacaaacatggcgcccgcgtttacgcctaagacacccgaatcggcaagcggatttctcgtgacaccctgcatgagggcgccggctgcggcaaaagcggctcctgtaacggccgcgccgagcactctcggaagacgcaattcatgaatgatctgctggcccgttatgttcggattgtaatcagcaacagccgaccaaaccgtatgtaaagtaatgtctttcgcgccgaatgagacggcgaaaaaaatagaaacaagcagcccgatcaccgcgatcaggaagaaaaccccgttttttaagatgctgatcagacggcttgcggacgtgacagaatcgctcaaaaatcaattcacctacttttatgatcattgtccggcatttattgaatatgagaatcattttcatttgaaccatcatattataccgggccgattttcaaaacgcaatagagtgttcaacaatgatgcccttttttctttcatgtttatattgtaaaaaagaagtgaaaaacgtgaaagaggaaatcgctatattcagaaaggagggaggcaaatggcgggagaaggaaagcctttgccgattgaattttaccagagaccgtcagtggagcttgcccctttattgctcggctgtctccttgtgaaggagacggatgagggaacggcttcaggttatatcgtggaaacggaagcttatatgggagcggatgaccgggcggcgcacagtttcggcaaccggcgcacgaaacggacggaaattatgttccatgaggcgggccgcatttatacatacgtcatgcacactcatacattaatgaacgtcgtcgcctcggacatcggcattccgcaggccgtgttaatcagggcggcggagcctcatgaaggacagttcctgatggagagcaggagaccgggcagacccccgagagagtggacaaacggcccgggaaaactgacgaaggcgatgggcatttcaatgaacgactacggcggcatgatcacggaaccgccgctgtatattacggagggctttacgcctgaacatatatcaacaggcccgagaatcgggattgacaacagcggagaagcccgggattatccgtggcgctattgggtgacggggaaccggtatgtctcacgctgaccatgtttataaacgctgataacaggggaaagacaaggtaaaagaaaggggattcagacattgaaaaaatttttcaaaacgattatcaaatgggcgcccgtcatctatccgattatcagaaaaatcataaaagaacggaaggcatctaagcggaaccgcatgtccgcatcccgaacagccggctgatccggctgtttttttacggtcttggcatcggattgccgcattgacttgaaatcctccccagtatagaatttacatacatttaccccttcctcattctttttgcccatttttcacatctgcatctgatctgataggaggtttttctcatgcttcatgggcggcttcgtgaacttctgcgcttgcttttagctgctgaaacaccggttacaagctcagtcatcgctgcaaatgtaaaggtaacgacgcggacggtccgcaatgacataaaggaactgcaaaccattgtagaaaaacacggcgcatccattcaatctgtcagagggagcggctataagctgctgatccggaatgagcagccgtttaaaaactggcttcaggacaatttccagcagaacagcaccgtaccgatttttcccgatgaacggatagattacctgatgaaaagaatgcttctggccgacggctacctcaagctggatgacttggcggaagaactgttcatcagtaaatccacacttcaatctgatttaaaagaagtcaaaaaacggctccgcccctatgacatcattttggaaacaaggccgaactacggctttaagctgcgcggcgaagagctccgcctccgttattgtatggcggaatacttagtggacgaccgcgagcccgagcctgatctcctgagtgaaaaggccggtattctgccgaaagacgacattcatgtgatccgcacagccattatgaagcaggttcgaaaccataagatcccgctttctttcttcggcctgaacaatctcatcatccatatcgccattgcctgcaaacgaatccggacagaaaactatgtatctctcattccggaagatcttcatgatattaagctcgaaacagaatatcagtcagcggaagccatcgtaaaagagcttgaatctgcgctttcggtcacctttcccgaacaggaaaccgcctatatcgccattcacctgctcgggacaaagcgcatgacccagtcacaaatggaaggaaaagagcttacaaggctgatagacggggaaaccagccgtttgacggaggccatgattgaagccattgagcgggagctgaagctcggaatcacggacgacaatgagctgaaagcgggtcttgcgctccatatcaagccggcgattaaccgaaaccggtacggaatgaacctgagaaacccgatgctctccgccataaaggagaattatccgctcgcatttgaagcgggagtgattgcgggaatcgtgatcaaggagcaaaccggcattgatattcatgaaaatgagatcgggtatttggcgcttcatttcggagccgctattgaaaggagaaagacggaacggccgcctaaacgctgtctgattgtctgtgcgtccggcgccggcagcgcgcagcttttaagagaaaagctccgttcccggttcgcaaaacgtcttgaaatcgtcggaacggctgattactgcagccttgaccagctttcctttgagtcgattgattttgtggtcagcacagtgccgatcaaaaaagacctgcccgttcccgtattgaaggttcatacgctgctgggcggcggggattttacaaaaatcgacgccatgctggaagaaaatcgggaacaattgaactttctgaaaccggagctggtatttttgcagcaggatctggagacgaaggaggacgtcatccgttttctcggacagcaggttgcagaagccggcctcgcttctgattctctgaccgattctatttttgaaagggaagcgatttctcctacgagtttcggcaatcttacggcgattccgcacccgctcgttccgcagacagacacgacgttttgggcggtatgcacgctgaagaagccgattgactgggcggataagcgtgtccaatttgtctgcctgctctgcgtcgagaaagaaagcaaagccgacctccagcatatgtacaaatggctcggcggcatgttggatgatccggccgcggtaagccgtctcttaaaatgcacaacctatcaggaggttttacgagtattcagagacaaacgatcagagaaagaccgggatacaccttttttccgttagcagcggaaaaagcctgagtagttatgaaagcgatttcataatatgatgttactaacatcgagacatacaaaatatcaaactttcaggaggtcttttacatgaatatattactcgtttgtgcagcagggatgtcaacaagcttactcgtcaccaagatggaaaaaagcgcgcaggaacaaggaaaagaatataaaatctgggcggtgtcaggcgattcagtcaaccagcatattgataaagcggacgtattgctgcttgggcctcaagtccgttatttgcttccgcagctgaaaaaattgggtgaatcaaaaggagtgccggttgaagtcatcaataccgtccattacggcacttgcaacggagcggaggttctgaaatcagcggaacagctcggaaacgcatcgtagaaaggggcgggccgtgtgaataaggtgaaccagtttttagaagagaaagtcatgcccattgccggaaaaattgcctcccagcggcatctgcaagcactgcgtgacggaatcatcctcaccatgccgcttatcatcatcggttcattttttctgatcatcggcaacctgccgattccgggatatgcggatttcatggcgaagacgttcggaagcgcctggtctcaaaaactgcaatatccggttgatgcgacctttgaaatcatgggccttgtcgccgctttcggaatcgcctaccgcctggctgaaaaatacggggtggacgcattatcggccggtgcgatatctttggcggcgtttctcttggcaacgccgtacaaagttccgtttctgccttccggcgcaaaagaggaaatcatggtgggcggcggcatcccgctgtctctcatgggaagcaaagggctgtttgtcgcgatgatcatcgccatgctgtcgacggaaatttaccgcctgatcatccagcggaatttcgtcttcaaaatgccggacggcgtgcctccggcggtcagcaaatcatttgtcgctttaattcccggctttgccgtcatctttctgatctggggtgcgcgtttaattgtcgaagcgacgccgtttgaaagccttcataacattgtaagcgttgtactggggacgccgctctcgattcttgggggaagtctcggcggaagcctggtagccgaagcggttcaaatgcttttgtgggcgtgcggattacatggggcgaacattgtcggcggcgtcatggcgccgatctggttcggagcgatggatgccaaccgtgttgcgtttcaggcaggcgatgcgctgccgaatattttcacccagcagttctttgaaatctggatcaacatcggcggaagcggcgcgacactggcgctcgtggtcaccatgtttctccgttcgcgaagcaagcagatgaagcagcttgggaaactcgccatcgggccggctgtctttaatattaatgagccgattattttcggaatgccgatcgtcatgaacccgatgcttctcattccgttcatcatcacaccgcttgtcacactggtctttacctatatcggcatgagcacaggcctcgtcgccaaacctgccggcattgccgtcccatggacgatgccgccgattttctccggctatcttgccacgggcggaaaaatatcaggggctgtcatgcaggcgattaatatcatcacagcctttatcgtgtactatccgttcttcagaatgtgggattcgcaaaagctgaaagaagaaaacgaacttgaacaatcgcaggcgccagccgtacagggagacgaaaaagccgtgctgtagagaaagggagtgaaacacatgaatgaaaaaatggaacagaccatttttcagatcatcctgcatggcggcaacggcagaagcgcatcaatggaagccattgccgccgcaaagcagggggacagagccatggccgaggaaaagcttcaggaagccgcaagggaactgaccgaagcccatcattaccagacagaattgatccaaaatgaagccggcggagaaaaaacagacatgacgcttttaatggtgcatgcgcaggatcatttaatgaatgccatgaccgtgaaagacttggccgctgagttagtcgagatttacgaaaaagtgagtctgcaagggggagcaaaaatatgacaaaaagaattaaaattgtaacgatcggcggaggttcaagctatacaccggagcttgtggaaggcatcattaagcgctatgaggaactgcctgtcagagaattatggctcgtcgacattcccgaaggcgagaaaaaactcaatatcgtcggcacgcttgcaaaacgcatggtcgaaaaagcgggtgttccgatagagattcacctgacgcttgaccggagagaagccttgaaggatgcggatttcgtaacgactcaattccgcgtcggtctccttgaggcccgcgccaaagacgaacggattccgttaaaatacggcgtaatcggccaggagacaaacggtccgggcggtttattcaaagggctgcgcaccatcccggttattctggaaatcgcgaaagacatcgaagagctttgtccgaatgcgtggcttgtgaatttcacaaaccctgccggcatggttaccgaggccttgctccgctactcgaatctcacaaaagtcgtcggcctctgcaatgtgccgatcggcattaaaatgggcgtcgcaaaagcattggatgtggatgtcagccggatcgaagtgcaatttgccggactgaatcacatggtcttcgggttagatgttttcttagacggcgtcagcgtgaaggatcaagtcatcgaagcgatgggagacccggaaaacgccatgacgatgaaaaacatttccggagcggaatgggagcctgaattcctgaaggcgctcgatctgattccttgcggctaccaccgctattatttcaaaacgaaagaaatgctcgagcatgaaatagaagcttcacagacggagggcacacgcgccgaggtcgtgcagaaggttgagaaagaactgttcgaactgtacaaagatccgaatctcgccatcaaaccgccgcagctggaaaaacggggcggagcgtactacagtgacgcggcctgcaacctgatcagctccatctataacgacaaacatgatatccagcccgtcaatacgataaacaacggcgcgatcgccagcattccgaatgactcagcggtcgaagtgaactgcgtcatgacgaaagacggtccgaaaccgatcgccgtcggtgatctgccggtgtctgtccgcggactcgtccagcaaatcaaatcatttgagcgcgtcgccgctgaagcagccgtcacgggagattatcaaacggcgcttcttgcgatgacgatcaaccctcttgtcccgtcagactccgtggcaaaggccattctggatgaaatgcttgaggcccacaaagaacatctgccccatttctttaagtcgattgaagcataagagcagtaaaaaaacccggattcgcttccgggttttttgcttattttgattcgcttagtgaggcgactttcgccgtccagccgaacacgtcggcttccgcgcctttttgaatgcctgtaatggtatcatacaatttcttcgagatctctccggtttcaccgctgccgatgacaagactttcatcattccagatcagttcgccgaccggagaaatgaccgccgccgtaccggttccgaatgtttcttccaatcggccgtcacgatgcgcctggatgatttcatcgatcgaaatcttccgctcagacacagtcagtccccaatgtttgagaagggtgatgacggaatttctcgtaatcccttcaagaatgcttccgttcagctccggcgtcacgatttcgccgctgattttgaagaagatgttcatgctgccgacttcttcgatgtatttcttctcaatgccgtcaagccataaaacctgggaaaatcccttctcttccgcaacctgctgcgctttcaggcttgatgcgtagttgccggcggttttcgcgtttccggtgccgcctttgacggcgcgcacgaattcgttttccacggcgatttttaccggtttaatgccttctttgtaataagagccgaccggggaaaggatgataaacagcttgtacgtatgggatgccgctacaccgaggaaaggctcggtcgcaataataaacggacggatataaagggaagtgccttccgctttcggaatccagtcttggtcgatggctacgagctgtttcaggccttcaagaacaagctcttcatcaatgagcgggatgcaaaggcggtcatttgactggttcaggcgctccatatttttctccggtctgaacagaagcacttcctgatccttcgttacatacgctttaagcccttcaaaaacggtttggccgtaatgataaaccatggccgcaggatccattgagatggactgataagggataattctcggatcataccatccttgatcggcgtcgtaatccataacaaacatatggtcggtgaaaattctgccgaacgcaaggttatgggggtccggtttcggttttttggctgaagtcaattcaacacgaatgtcttgtttcataatgttctgtctccctattggtgttattgtcaaacttatttgaaaataatttatattctattgtataccttcaacaaatattcgcaatagttttcctcaaatttgtgaaaaaatcaaatcacataaaaagcaggggagagaatgccccctgcgtgttcgtttttacatattctgtaatcatcgtgctcagtgaaccgtcaccttgccggttttgtaaaactgctccattgctttatcgacgtacacccagcccttccaggcgatatggatggtgtctttcataaagtacggatcatattcgtgcccggataagtcggcaacctgaaagcccttcgctttaatttgcttagtgacttttttgtagtaatcagtccggccttttttcgggaagccggtgtagtcataccattttccgttgaccggaataactacgaacatcggttcagcgccggcatctttcagaatgtccagcatatcctcaaagtcgtgatattcgactgatttggcgtacgttcttcctttgttgattcctttcactctctttactttcttcttaatctttttataagaagcgtcatcgatatagaaaggattggacttggagctccgttctcctaattgagcggcggctgtttttaactctgaccacgatttccctttcaggttttcagagatcgtccgttcagggcccttggtttctcccattgaataataaagatcttttttctcaagcagagaataataagctttggcagccggcatgaccgctttcactttccatgattgtccgttgaccattcccttgtataattcagaaaggacggcatcatgctgaacaactttaaaacggagcatgcgcttcatcatgttctttttgaccgcgggatcaatctggttattaaatgctaaatccaatgcctgaagtgatgaaaaattcggcgcaaagtgctgttcatcagaaccttttttgataaaccattgcggagaaacaatgaataccagctttttgcccttcagctgctgataatgcgccgcaaagttcacggcgtgtatcaaggattggtccccgccttttccgacaagataaggcgtaaagccttggttgttcacttggaaatagttggacgggtgaaactcatccagtcttgaaagctcggaagaaccgaaaatcggcatatacttcgagtcttcgaacattttgttttgcagatagaggccctggaacatattcggatttaaggccgctgccgactcttcgacacgtttttcaggaatgaagcgcgtaagccatgaagccggaactgcgatagctccgacaaacaggacaaacgctaaaataattggtccaaagaaacgctttttcatttacttcaactcagtcagtttgtttacaatgttgtttggcgtattccactcgtcacggtcaaattcagtgatcggcactgtaatgccgaagcggttttcgatggcgacaagcagttctacagttccgaaagaatcaagcagtccttcttcaaagatttcaatatcaggattttctttcacagcgtcctcctgacaaacttcagctaatacgtctaatacttcctgtttaaattccatgtgttttcaatctcctttagtgatgaaatggttttcctgagaaaatataaaatccgaaacatacgaaatggaatgtgatgacgatggctaaaaaggccgtaaaacgattggcgggcagccacttgtatttcttattccatttctcaaaaaagttatacccggtcattaatacggcgtggtaaaggccgtatataatatattgcagggcgagtccgtgccagacgcccatcagcatgaacagcaggaaatacccgatgttcgagacggccatccggttctttatccattttttctttgtcatccagaatacaaagcgcataaatacgtagtctctgaaccagaaggataaggacatgtgccagcggttccagaagtctttaatgtttttgctgataaacggcttattaaagttttccggagatttgatacccatgatatagcttacaccgacggcaaacatcgtgtaacccgcaaaatcaaaaaacaggtacaagctgtatccgtacatgtacagcacattaccccacagtttactgtgggtgatatgaggcagattcataatgaaatacgtgttaatcgcatatccgataatgaatttgtacaagaaaccgataaaaattttatgaatgccggtatacagtaaatcagcgtattctccctttgtccatactttctgttcgtccttggcaaatctgcggtatctgtcgatcggaccggaagaaatggtcgggaaaaacataataaagtacaaaaggcggtgaagcggcattttttctttaatcagtccgtctctcgtttccatgatcagctggacgcctttaaatgtcaaataagaaattcctaagaaactgatcaggttatgaaccggatgatgaggcgccggcgggaagaaaaacggccataatttagataaaaacaggggtaaaatggacgcgatcacggccatactgaagacaaagccgctgttggctttcagtctgtaagcgagataacccctgattaaaagcacctgccacagcgtaaagatacatagtgcgatcacgccgtgcagatcatgcgcgaaaatcaaagccaatacgatgatggatataaacatgttgtatccttggaatctcttgccgttcagccctaaaataatcgtcggcaaaagaaggattccaagtaagataaagaagaaaaacgagctgtaaggcgtcatacaagaacctcttcgccaatgcgtttacggtcgatttttccgttcgcagtcatttgaatgtgatcctgataaatgaattttctcggaatcatgtaggccggaagcgaagcggccagttcttttttaatggcgcttgtcagctggaattctttttcaaaatcatgtttttcaggcacgatggcggcaattaaatattcgactggtccgttaggctgatacgggatgacaaccgccgtctgcacatattgagactgccttacatgtacttcgatttcctccagctccatgcggtagccgtgaagcttaatctggaaatcaaggcgtccttggcagaaaatctgaccatcctgaacataaccggcatcacccgtgtgatatgcccactggccgtcaattgagaaaaacgctttttccgtcagagacggttcaccgagatagcctttgctcacgctcggcccggcgatgatgatttcccctttttctccgtccggaagcttattcccgttttcatccatgatgaagatattcatatcgggttttgcaaaaccgacgggcagagattcattttcatcgataatctgctgcgtaatttcaacggaggtgacggcaaccgttgtttcagtcgggccgtatgtattgaatacgcgggccttcggaaaacggtttaacagttcctgtgccacggcagccggaagcgcttctccgcaaaacataaatacttctgcctcaggcaggagctcctgcgtaaagccggggtccatcagacacatttggacgaaagacggcgtcgatgtccagacgttcagtttggatttctccagctcttcaaatagtactttcggtttattgattttgtctttcgttacgcagtgcagcgtacctcccgtttgaagcgacgggaaaatgtccatgacagataaatcaaaagaaaacggagcttggtttaagaatgtcttacccccgcccacaggaaaatccctgcagatccagtcagtgaagctttgcaggttatcagccgatatctgcacgcccttcggatttcccgtgctgccggacgtgtaaataatgtaaaacgtatccagctcttttacccagttctcacggctgaggtctgcatctccgtcagctgcaagctcttcgggcgtaacggttttaatcagattgcttcccgtatcgactgcatcgcccgatacgctgataagcagctctgcgcctgagctttcaatgattttgacgatccgctccgccggaatggaaacatcgacagggatgtaagggcggcccgctttgacgcttcccaagaaagaaacaatcatattcggctccatatgtccgtaaaccaggacaggcgctttcgaaccgtcagctgtatgtttttgaatgccggacgcaacccgctccgacaaatcccataattccccgtaagtgagggaatgatctaaggaacgaaacgcttcggcctgcggcttggcgtctgcgtatgtttttatagcatcaagtagtttcatagttatcctccccgattagaaatcgttgtaaatataagtgccggtattcgctgtatgaaatccatacatccaaaagagcaatactaatatcagaaaataaaagcccgtatgaaacgtccatttgatcaatgtattttcataagcacgttttaatttttgcatcatattcaaaattccttccccgcgtattcaataattacaccagtatatgacgattagattaacaaaaagtttcaaaatatgtctaatatcctaagcttaaaatttccttaaaaatgaatgagaaacaaaaggatggaaaacacgcatgtataaattggcaaatgatcatactaaaaaggcgctgttcaggcgggatttttaacttatcgtaaatataaacgaggtaaaaaaattttggcggctttttcttaagcaggcttgtgccgaaccccaagggagaagggcgaaaagccgtttccggcaggatagctgataaagcgccgcatcttgtgaaatgaggaagaaattattatgatagataaggtagcagaaaacgtgaaaaccccaattcaacactactgttatcggctgactgtgaaagccttttaatagaaaggaagaggaaaatgaatcaaaacaatatggggggcagccaaaagacgcccgagaaagaaagcatgggccgcattttgtggcagctaacccgccctcatacattgacggcatcgtttgtgcccgtacttctcggcaccgtattggcgatgttttacgtaaaggttgatttcctgctgtttttggccatgctgttttcctgcctttggatccagatcgccacgaacttattcaatgaatattacgattttaaacgcggtttagatacggaggattccgtcggtatcggcggagcgatcgtccgccacggcatgaagccgaaaacaattctgcagctggcgctcggctcttatgcgattgctctcgtgctcggtgtttatatctgcatgagcagcagctggtggcttgcggctatcggccttgccggcatgctgatcggctatctgtatacgggcggcccgctgccgattgcgtatacaccgttcggggaactgttctccggcatttgcatgggctctgtatttgtccttatttcttttttcattcagacaggcagaattaatgaacagagcattttgatttccatcccgatcgccatcctggtcggagcgattaacctgtccaacaatattcgtgatattgaggaagataaaaaaggcggacgtaaaacgctggccattttgatggggcatagaggggccgttatgatactggcggcatcttttgccatcgcttacatctggatcgtcggtcttgtcatcatgggttacacaagcccgtggctgttcctggtctttttgagcgtgccgaaacccgttcaggccgtgaaaggctttgtgaaaaacgaaatgccgatgaacatgattattgcgatgaaatcaacggcgcaaaccaatacattcttcggattcctgctttcaatcggactcctgatcagttatttccgctgatcaaatgaaagggcaaatgctataaccggcatttgcttttttttatgacataatcttcacgatattgtaaagaacctgaccgcggactgacccgtctcatatatggacagcaaagcaaggagatgaaaaaaatggacttgtcaacagcccatatggatgatttaaaaacggtcatggaagattggaaaaatgaattattagtttataaattcgctttagatgagctggatacgaagttttctatcatcagccaggaatataatctgattcacgggcataacccgatcgagcatacaaaatcacgcgtgaaaagttttgaaagcatcgtcaataaactgatgcgcaaaggctgcgatgtgacgacgcaggaaatgaaagagcatattcatgatatcgcgggtgtcaggattatctgttcctttatttccgatatttataatgtcgctgaggttctgaagcagcataaggacctgaagatcgtaaaggtgaaggattatatcaaacatccgaagccgaacggctaccgcagcctgcatttgattattgaaattcccgtttatttgacgaatcgtgtggaatatgtgaaggcggaaattcaaatccgcaccatcgccatggatttttgggcgagccttgaacacaaaatttattacaaattaaataacgaagtcccaaagcatctgaccgacgagctgaaggaagcggcggacatcgcccattatttagacgaaaagatgcttgggattaagaaagaagtcgattaaacgattgacccgtcacaaccagccggaccgctattatacgcagtccggctggttgtttatccgtttatgcgcagctgtacaaattttcgcctgcccacctgaatcgtcatgccgtcttctgcggtaatgacggtatgaagggcatccgttttctccccgttcactttgattccgccgttttgaatcatacggcgtgcttcgctttttgaagaaaagagtccaagcgtgacaagcagctcaataaggggcacggtcttttctccgtcccatatgacggttttcatatcttcaggcaggctgttttgctggaagacacgtttgaaatgccgctctgccgcatccgccgctttcgtgccgtggtacattctgacgattgtacccgctaagatcattttggcatctctcggatgaagctttcctgattccaaatccttctccatctgttttttctccgcaggctctaagtctgtcgctaaatggatatatgttttcatcaggctgtccggcaatgacatcgttttgccgtacatgtcgttcggatgctcgtcaatgccgatatagttgttttttgatttagacattttttcaacgccgtcaagaccttccaaaagcggcatgaggatgacgacctgcttttcttttttgtagcgttcttggaaatggcggcccatcagcacgttaaaatgctggtccgtaccgccgagttcgatatcgctttcgagaacgacagaatcgtaaccctgcatcagcgggtaaaagaattcgtgaagtgagatcggtttttgcatggcgatgcgctcctcaaagtcgtcgcgctccatcaggcgggcgacagtaattttccccgctaattcaatcacatcttccagattcaatgtcttcagccattttgagttgcagtgaagttcaactttgtcttgatccagcaccttgccaaactgttcaaaataggttttggcattgtgttggacttcttcatcagtcagctgttttctggcttgcgacttccccgtcggatcaccgatttttccggtaaagtccccgataacaagctgtatgatatggccgttttcttgaaattggcgcagtttgtttaacacgacggtatggcccaagtggacgtcgggtgcggacggatcaaggccgagtttaatgttcagcggcttgccggatgccactgatttggcgattttatttctcaattcttcaggcggtatgacgtccgcggcgccggtcatgtacaaatccagctgcctttgcacttctttttcctgatcattcgttaaagtgattgattccatcttttacatcctcctttttttagccaaacaaaaaagccgcatcccaaaaagggacgtggctgtatgcacgcggtaccaccctgattgaagacgaaacgacgtcttccgctcattcgaataacggtttcccgttctttgctactgaagttcacaaagaaagctcagggaggtaattcacgtttgtctttgtgccggcttgcaccatccgccggctctctgaaacagggagacaatccgttactgattcccgtcatagctgctatgttatgaaattgtcagcgattttttgcagcagggcggacagcgttttttgttcctgtttatccagacaggccgtcagttcaatttccccctgatgaaagtcggggtacagatcttcaataacctttctgccctcatcggtaatactgacgaatacaagcctgcggtctcttttgttcgtttgtctgctgcataagcccttcttttccaaagtgttcaggacattgctcgccgtcgccgaggtaattccggatagagcggctatccttcttgtatcaagcgtttcccattcacaaaggtcatacaggatggaaaacgccgtccatgataatttgtgtgccgacagcacctctttctccatttttacacggagctgctgggcggaccgatagagtgcagctgcaatataggccgcctctttgtttcggccggatagatcggaaaaaggcctgttcggcttcttattgtctgatccggcatcgttgcgaatcgtcaatggcgtcatgctccttattattgtcagaatcattagctatgaaatgaattttaacagagaatgcgaaagatatcaaatcgcaaacagcacattcccgcagaaaaaatgtgtaagattgaggtttactttttaaaaaaagggaaagacatttgtacaacaaaaagggagatgaatatcagtgggaaagaatgaaacaatgcatatcgtatcatgtgccgatgataattatgctcgtcatttgggtgggatgttcgcttctttattgatgaatatggataaaacaaggaatgccaaattatatgtgatcgacggcggaattactgccgaaaacaaggacaagcttgaacagactgcgatgtcattcgggacgccgcttgaatttttagaagtagacgctgatcaatacaagcatgcagtcgaaagcagccatattacaaaagcggcttattaccgcatttctatccctgatttaattaaggatgagtccgtaaagcggatgatttacatcgattgcgatgcaattgtgatggaagatatttcggttttatgggacttggatatttccccggcaatagttgcggcggtagaagatgccggacagcatgaaagactgaaaaaaatgaatatcagcgacactgccaagtattttaattccggtattatgattatagatttcgaaccttggagaaaacagaatatttccaaaaaagtgattgattttatcaatgataacagctcggaggattttctcgtgtttcatgatcaggacgcgcttaacgcgatcttatatgatcaatggcatgaactgcatccgcgctggaacgcgcagacgcatattatcatgaatgagaaaacgcctcctgaactgatcgaccgtatacgttacagagaaacacgtgccgaaccggccatcgtccatttctgcggcggggacaagccttggaatacaggcacctcgcacccgtatcgtgatcattatttccgatatatgtcctttacgaaatggaacacgattgaccgcccggccatgaaccaataggcaggtgtgatgaaaacgcttgtgaagccgttgaccggctcacaagcgttttttttattatttcacccgaatcgcacgcacgcgtttttgcaggctggtcttttcggcagacggcttcaatcggctgactgccgtttgcgccgctgattttgcttttttcgtcttggttttttccgccgtttttactttgtcccttgcctgctgccggttgagtttatcttttatccagccaagccgtttttccagaacggttttttcttttcccggctggatttcgctgactgctttttgggcttttgcggtgttggcctcagaagtctttttttccgcctgcttgacgctggcctcagcagttctcaaaaggcttgagttgacagcgttcagccgcttttgcagcccttttttctctgaaccggccggtaatttgcggatggcgctttgtgcggcattgacggcggtttttttcttttgtttttcggcagtccggactttgtctcttgcgtccgtcacatttcttgccgtctgaactttattgatccgcgcctcgagagcggtttttccttttgacttggacagtttgctgactgccgtttttgcttcatcgatatctgcctgctttttcgtcttttccgcttttattacggcccgttcggcaaagctcttttgttttgtgtgatattgcgccagtccgtagccgaatcggctgtcacgtccgggagcgcccagatctttgacgttctgctgcatctgctgccggagctgtgtatttgtttcctccggatatttctgcctgagcagcgcgaacatgccggtgacgtgcggcgcggcttgagatgtgccgtcagctgtggcgtacatttgattcagatacgtgctcgtaatattagtgccgggtgcggcaaactcaatttgttttccggtcgtggaaaaagctgcgagcccgtttttttcagttgacgctgagactgccgttacgctgctgtaggcgcccggataattgacgggttttttattgccgtcgtttcctgcggcggcaacgatcacgattccttttttgtaagctttgtcaacggcgtcgtgaagacttttgctgtctgcgtttgtcccgaggctcatattgatgatgtccattttattggcgatcgaccagtcgatcgctttaagaaggcttttgagatctcccgctccttttctgtctaatgctttaaccgcatataaccggacatccggcgcgatgccgtcgatgccgtatccgtcatgtttggccgcaatgattccggcgacatgcgtcccgtgtccgttgtcatctttgtatgagggagtatagctgactgcggaatagcctccggcaatggagagatcatcatgagggtaaatgccgctgtcaatgacagccactttcaccttttttcccgtcaagccttctttccacgcctgcttaacctgagtcggttcgatatcccattgcggcagcacgtaactgctgctttgggcagctgataacgggcggatatcagaaccgcctgctgcctgaaaggatacattctcttctacatataagatgtcagggtcctgtttcaggtctttcactgtttgcgaatcggctgacacggcgactgccgggagatgctgataggtctgttccacatccgctccgctgtctatggcggattccttgccgttttgatttttgtacaccacgataacgtcccggtcatgcgtctcggcgtgcgcgggcgccgcggcggagaacaggctgatgcacaaggccgcggccattatcggtttcagggtgtgatacattgcgattccccctttttctttatatatcggcagtgcggaattctttttttcctgaggggtaaggaaaatttctgtatgcaaatgtaagcgtttccaaaatatgatggagaaaatgctttaagacatctgcgcaatgaactcaaaaagggggtttttgataaatgagtacgttcaatcgggtcatggaagaaaaaatcatgcctgtcgccggaaaagtcgccggccaaaggcacttaagagctttgcgggacggcattattttgactatgccgcttatcatcatcggatcggtttttctgattctgacgagtcttccgattcccggttatgccgattttatggctggtcttttcggtgaaaattgggttgaaaagctcgggtatcccgtgaatgcgtcctttgacattatggcgcttgtcgccgcctttgggattgcttaccggcttgcggaaagctatgaggtggatgccctgtcgtcgggagccattgcccttgccgcctttttattggcgacgccgtatcagattccgtttatccctgacggctcgtcaacagagattatggtgggaggcggcataccgatttcgctgctcggaagcaaaggtctgtttgtcgcgatgatcattgcaatgctgtctacggaagtgtaccggtttattatacaaagaaatatcgtcattaagatgcctgacggagtgccgcctgcggtcagcaaatcgttcgttgcgctcatccccggtttcattattattacgcttgtatggctggcccgtctgtttattgaaataactccttttaaaagtctccacaatgtcgtaggcgatctgctgggcaccccgctgtctattttgggcgggagtctcggcggaagtcttatcgccgaattcgtgcaaatgctgctttggtcgtgcggcatacacggcgcgtccataatcggcggcgtcatgtcgccgatctggtacggggcgatggacgccaaccgtttggcttttcaggcgggagaagcgctgccgagcatttttacgacacagttctttcaaatatggattaatgtcggcggaagcggagcgacgcttgcccttgtgctgaccatgcttgtgcgctccagaagcaaacagatgaaacagctcggccgtctcggcatcgggcccgcgatttttaacattaacgaaccgattattttcgggatgccgctcgtcatgaatccgctgttaatcgtgccttttattgttgcgccgctcttgaccattacggcgacgtacatcgggatgagcacggggatggtggcaaaaccggcgggaatcgccgtgccgtggacgatgccgccgctgatttccggttatttggcgacgggcggaaaaatctccggttcggtcatgcagctgatcaatctcctgattacatttatcatttattatccgtttttccgaatttgggatcttcaaaaatggagagaggaacgggcggcggaacaaaacgtcacagaagaaacataaaaaaaaacgggcgctttcgcccgtttttttaacgctggaaaaattcgatccattcgccgtcaggtccttcaatgtaaaagtagcggtacccgttcggaagtgtcgtgatttcttcatcaatgaatacggcgccctgacgcttcgcatgcgtgaactccgctgcgatatcttcagtcaataaagcgacatggtgcacttttccttctgcgggaagctcgctgctgtagccctggatcagctcaatttctgtctccggcccttcttgaaagccgagaaaggcaagttcaataatgccgttcgtatgagtgatacgatcctttaactgcataccgagaacgtcttggtaaaaggcgatggatgtttcaatatctttgaccataatgcctgtatggtcgattcttttggctgtcatggttttccccctgttttgaatttttcgggacaatgcggtgttgatcatgttttatggtacgataagagaaagcaaaacgaaagaggaatgcacaatgaagctacttacagtgaaagatacatttgccggaaagctgaaaaaaggattccccctgattgaaaaagacgctctgtccggaagctcggctcatttaacagagggcgatctttttgatgtgacatccgagaagggtgagtttatcggaaaaggctattacggtttgcagaataaaggagtcggctgggtgctgtcccgcgcgagagatgaacggatcgacggacgtttctttctggacaagctgaaaaaagcggctgaagcaagagcccatctgtttaacgcgcccgatacgacggcgttccggcttttcaacggtgagggcgacggcatcggcggcgtcacgattgacttttatgacggttatctgctgattcaatggtacagtaaaggcatttacgcttataaggacagcatgattgaggcgattgacggactggagctttcttataaagcgatctatgaaaagaaacgattcgatactgccgggcaatacgtggaagacgacgattttgtcaaaggcgaaagaggagattttccggtcattgttcaagaaaacggcatacggtacgcggcggatttaaacgatggggcgatgacgggcattttcttagaccagcgtcatgtacgcaaagcgattcgggacaagtatgcaaacggcagacgggtgctgaatacgttctcttatacgggggcattttccgttgcggcggcgcttggcggagctgagaaaacgacaagcgtcgatgtcgccaaccgcagtctcgcaaaaacgattgaacagttcagcgccaacggaattgattatgaggcgcatgacattaaggtcatggatgttttcaaatacttcggctatgcggagaaaaaagggctggcgtttgacctcatcatccttgatccgccttctttcgcccgcacaaaaaaacggacgttcagcgcggcgaaagattataaaaacctgctgaaggaaacgatcgccatcaccgcaaaaaacggcatcatcgtcgcttcgacaaacagcagcgccttcaatatgaagaaatttaaaggttttatagagaccgcctttaaagaaacaaatgagcgttacgacattttggaagaatacacgcttccggaagatttcaaaacgattccggcgtttaaagaagggaactatttgaaggttgttttcttgcggaaaaaataggatgatcatttatagcgtggaaagagggggaaaagaaaaccctcttccatcgctttaatacgggataaataatcttcatatcttactgtttaaagaaaaaacccgctattatttagtatctcatctgtgccaagtaaagtggcctcactaatccctccgcccaattgtatcctcgataatgattttaatgggcaccaccctttttttgagtatctatataaattgtaatggcatcactcatgagcttcgccaacccttcaccataccggtcgatgttcttagtgaagcgttcatcttcaatatagagttgacctaatccgtaaaaggcatcaaaagaatattcaccaaaattttcattgagaaaatcaaaccactctttgatagctgtttgtacgtctggggactcgggagattggttaataaggagtgcaaatttattgaacattgcagtccacttatcagataaatctttttgctcaccatcagtcatgtttttcaatctaatatttaccttatcgacaggttgatcaccccaccgtttgcgggcttcttgctcataaagattatcattaaagttaattccctcaaaccgctctttgttcgtcatgcaaatctctcccatcatatgtttgattgatttatcgatggtttcaatcatcttattgactctattccgtttctcaatcaacattttcttttgtaaaatgaatgcttcccttcggttaaatgaaggattagtaatgatttctttaatctcttttaaggagaaatcgagctccttgaaaaatagtatctgctgcagctgttcaagattctcttcagaataaagccgataaccggaatcggtcgtttcctgaggagtcaataatccaatttgatcgtaatgatggagagtgcgtatgcttactccaatcaggtcagctacttcttttactttcatacccattacgtttgccgcctccttaatggctactctaaagtattacgcaacgtaagagtcaatagttggttaaaaattttttgtatataaagggagaacatatgaggatttcattgctgaaattaaagaaaaaaaagccgggcgtgaagctccggcttttttctattcaataatgtgctgcacccggccgattcgcccgtcttcaaggcggaccttaatgccgcgcgggtggaagcttgagttcgtcaaaatatccttcacgattcctcttgtcagctttcctgaacgctgatcggctttcaggacgatatcgacttcaagtccttttctgatgctgcttcgctgctggccgttcatatgacacatccgttcttcagtcttttcacttcatgtcttatcatatcgtgttttcgtctttttatgaaggacagacaaatcaattcttcatggcaactaaaaaaagaccgctctgtaaggagcagtcttttatgacataaacgaaagcaaaatcggggccgcgcacagtgtcataatcgcggcgagaatcatggacacgcttgagatcgttcctgatacggagctgagctcaaatgctttagatgttcccgctccgtgcgcgctagttccgagcagcacgccccgggcaatttcgttatcaatgcggaaatagcggatgaccatcggcccgatgatcgttcccaataaagccgttaaaatgacgaaaaccgctgtaacggccggcatcccgccgatcatttctgaaacgttcatggcaatcggcgtcgtcacggatcgcggcacgagactgtcgactaagctgctgccgagattgaaccattttgcgataaaggctgttgacagaatggcgatacatgaaccgaccgctacgttcaaaataatttccacggcgtatttctttaaaatcgggaaatatttataaagcgggatggcgaacgccactgttgccggctgaagcatatcggtcagcagtccgccgccgagattgtatgtctgatacgggacattgacaagaagcagcagtacgaccaaaacagcgggcgtaatcagaagcggcgacgtatacacccgcggaaaacgaatgtagagttttttcgcgcccaaatatactaagacagttaagaataaacttatgattccgatgaacacgtttgttttttctcctttctttttgctatcagctgtgtaagcgtacctgttgaaaccatcacgacaaatgtgctgatgacgacgacaagtaaaatgcttacgccgaatttagacataatatctccgtattcaatcactccgacggcagacgggatgaaaaacagcagcagctcaccgaggagccatgctgcgccaagctcaatccattcaagtttgataatcttgaaatgcaataatgtgaaaagaatcacaatcccgattatactgccgggaatatttatatgaagagccgccgtgatccaattgatcagacgcgcaaatataaacagcagagcgatttgaataacggtaagcagcaattttttcataatgatgcctcccttatatttatattgtacagaaggttttgctataggtaaaatacatataaagaataatgtgtattccttttgtctatagaaaggatgaaatgtaatggatatccggcacttaacgtatttcttggaagtggcccgtttgaaaagctttacgaaggcttcacagtctctgtatgtttcacagccgacaatctcaaaaatgattaaaaacctggagacggagctcggcattaaactgttttaccgcaatggccggcaagttgaactgactgacgccggacagagcatgtatgtgcaggcgcaggaaatcacaaagtcattccaaaacctgacgtcagagctgaacgatattatggaagtgaagaaagggcacgtccgcatcggtcttccgccgatgatcgggtccggctttttcccgagagtgctcggtgacttccgcgtcacataccccgatgtgacgtttcagcttgttgaggacggctctattaaagtgcagcaaggggtggaggacggctcgcttgatatcggggtcgtcgtgcttcccgcgaatgaagagatttttcataccttcacaatcgtcaaggaaacccttatgcttgtcgtccatccgtcacatcggctcgctgacgagaaagaatgcagtcttcatgaattgaaagaagagccgttcatatttttcagggaggattttgtccttcataatcgaattatgacggaatgcgtgaaagccggattcaggccgcatgtcatttatgaaacatcacagtgggactttatcagcgaaatggtatccgccaatctcggtatcggcctgctgccggaaagaatctgtcgcggtcttgatcctgacaaagtcagaaccattccgctcgttcatccggtcattccgtggcatttagccatcatttggcggaaggaccgctatatgtcctttgccgccagagcctggctggagcatacgaaatcgtatttatggaatccgaaaaagagaaaaaaggatgattaagcatggacgcacaaaccgcagctcaacacttgagtaaagtgcgggatcaaaacccgctcgttcacagtatcaccaataatgtcgtcacgaacttcaccgctaacggactgctcgcgctcggcgcatcgcccgttatggcttatgcaattgaggaggccgccgacatggcgaaaatcgccggagcgctcgtcctgaacataggcaccctcagctcggcatcggttgaagctatgatcgcagccggaaaatcggccaatgaaaacggtgttccggtcatttttgatccggtaggcgccggcgccacgccgtttcggacggcatcagcccgcaagatcatacaggaggtccgcttgtccgttattcgcggaaatgccgcggaaattgccaatattgccggcgcccctgattggaagataaaaggcgtggatgcgggggaagccggaggagatgtggttcagctcgctaagacggctgcaagcgggctgaagacggtcattgcgattaccggaaaaaccgacgtcatctccgacggcaccgacacatacgccgtacaaaacggtgataaactgctgacgaaggtgacgggggcgggatgcctgctgacgtctgtaatcggagccttctgcgcagcggggcaggacgttctgcaagcggccgtttcagccgtttctgtatacggaagcgccgctcagcttgccgctttggacacctcccataaggggccgggcagcttccagattgagcttttaaacaagctggcaagcatctcagaacaagaagcggctgagcttgccgcaattgaaagggtgatagaaaaatgacgcgtatttctcgggaaatgatgaagaatatgttatcggtttattttattatgggatcaaacaatacaagcgcagacccggtttccgtggtgaaaaaagcaattgagggcggcgctacgctttttcaatttcgggaaaaggggagcggttctttaacaggggatgaacgtgtcctgttcgcgaagcgggtgcaggatgtctgcaggcaggccgggattcctttcatcattaatgatgatgccgaattggccttgcgccttgaggcggacggagtgcatatcggacaggatgacgcagacgccgaagaaacgagagcggcaatcggcgatatgattctcggtgtgtcagcacataacgtctccgaggtgaagcgggcggaagaagccggagccgattacgtcggaatgggcccggtctatccgaccgaaacaaaaaaagatgctgaagccgtgcagggagttacattgattgaagaggtacggcgtcagggcatcaccattccgattgtaggaatcggcggcattacggctgacaacgcggcgcccgtcattgaagcgggtgcagacggcgtcagcatgatcagtgccatcagccaagccgaagatccaaaagcggcggcgcggaagttttcagaggaaattcggcgctccaaagcagggctgtcccgatagggcggccctttttctgtgtgcgcaaaaaggcgtgacggactgggagaatagaagccgtatgtcaagaacagagcaatcaagcttgcaatatcgaccgaagcgtttgacggctctatcgcttctctcaaagtgacgcctgaaccaatcagcgcaggctcaaaagccctctataaaacagtgaatagcgcgaagtgagagaccatttcgaggtcacggaaaaacttaatgcggaattcagcgaatttgaagttttgatgtcgaaatacaaaacgtgcgatcaatgtatacgtcttgtgatacattaagtacagatcaaatcagagagataagcacgaagctgacggccctttctgaaaccatgtcgaagattgccgatgtgctttaaaaggagttaagacacagcatgagcgatgaacataacaaggaaaaacagatccacagacgggatgtcctgaagtggggcgccgtcgcgggcgcagccgtcgctgtcggagcgagcggcctcggaggactcgcgccgctcttcaaaccggcggccaccgcttcaaagaagaatgatgaaaaacgtgatcgtgatcaaatcgttcctttttacggaaagcaccaagcaggaatcacaacggcgcatcagacgtatgtgtattttgcggcgcttgatgtcatgtcaagcgacaaagccgatgtcatctcccttttcaaacaatggacaagcttgacgcagctgctgacttcaggcgccgtcccgtcaggcgaacagaaaaataaatatatgcctccgcaggataccggggagtcgcaggatctggcaccggcgaatttgaccgttaccttcggcttcggccccgggtttttcgagaaagacgggaaggaccgcttcggactgaaagataaaaaaccgaagcacctcgccgatattccgccgatgcctaacgacaagctcgataagaaacaaggcggcggtgatatcgtcatacaggtctgcgcggataatgaacaaacggcgtttcacgcggtgcgcaacctgatgaaacaggcatcgggtgtgtgtgaagtccgctttctcaataaaggtttcttaagcggcggaaaaaacggagaaacaccgcgcaacctcttcggattcaaagacggcaccggcaaccaaagcacgaaggatgaaaacctgatgaattcgatcgtttgggttcaatcaggagagccggactggatgacgggcggcacgtacatggcgtttaggaaaattaagatgtttttagatatatgggaccgttcatccttgaaggaacaagaggacacgttcgggcgggtgaaaagctcgggcgcgcctttcggacaaaaaaaggaaaccgatcccgtgaagctgaatcaaattcccgccgactcgcatgtcagcgtggcaaaatcaaccggcagacagattctgcgccgggcattttcctatacggacggaattgatccgaagacgggctatgttgacgcaggcctgttgtttatctgctttcaaaaagacccggaccgccaatttgtcccgatgctgaaggctttggcggcaaaggatgcgctgaatgaatacacacaaacgatcggctcttccttattcgcctgtcccggcggctgtaaaaaaggagaatatatcgcccaaaggctgctggaatcgtgacaccttccatatggagggtgttttttttaaaaaaaacacttgtaactataaaagttacaacttaaaatgataaggaaaggagacttacaatgacactgcagattaaagtatattctgattatgtatgtccgttttgctatgtcggcaaagcggcgtttgaagaagcaatcaaggacaaggacgtacaggtggaatggatgccgtttgaattgcgtccgagcccctcgccgaaacttgatccggtgaatgatcccgccaagcggcagatgtggaaaaactccattgagccgatggcgcagtcgttaggcgttgaaatcacgttcccccgcgtgtcaccgcatccatacacggatttggcatttgaaggctttcatttcgcaaaggaacacgggaaaggaagcgaataccatacacgcgtttttcaggcgttctttcaggaagaacaaaatatcggtgacgttggcgtgctgacaaagcttgcggaagaagccggacttgacggcgctgccttcaaagaggcgcttgagacaagagcgtacaaggacgtacagcgggaagcgctccgccatgcttatgaggaagccggcattacggcagtgccgacgtttatcatcggcgatgagagaatccctggcgcggcgggaaaggaaacctttgaacaaatcattgagcgggaactgaataaacgttaacccgaaaaaagccctctcgatcagcgagagggctttgccatatagtgtttgacaaatgtttgtctgtccgcttcatatgccgcggcgtcaaaggagtcgccgcaaaaatgaaggcaccaagggtctttctggcaggcgacgccgacttgatagccgtgtttttgaaattcgagcgactgtgatgtgtcgtaaaaatgaaagccgcgaaacaaatcctcccgccactccacgtcatattgagccgccattaacaagccgtcaatggcgtcagcgggcgtaaacaggccgtcttcatcaccgtgctcaaaatccagcgggtgataagcattcccccggtattcaatcacttttcccatccgctgtccgctttcccaccaaatgccgttcggcggcagggttttgcagccggcgacaccgagaaggccgagctcctgatgagattgaaagatatgaagcatgtcatgaaggaaatgctgatgaatgataaaagtatcctgatgcagataaattttatatttggaggggtgtttcagcgctttgttgtaggacgaggccatgcttgctgaatcgtatatcggcatgatatcaacggagtatgaagggggacggtaagctgcatgatatggctcttgcaccgggagtacagcgactcatcattcacacagacgacaaacagaaatgaatgtgaatccattacatgctcctctcggcctcaatcacatattgataggccgatgcttctgtcataaagtcatgccttatgccaagctgtacgcatacttcgtgcaatgatgcgatggctttgtggtaagaagggtgatcaacgcggatcgcctcaatgcgtttgacctcatagctggcggctttaaataatgaaagagtctcttcccgggtaaaaaaacgcaggtgggtctgatccattaatccggcgtcactgtaagtccatttgccggctaaaagctccaacacgactgagatgtggccgacattcggtatgcatgcaagcacagtgccgtctttttttacataaggacgaagctttttcagcactgtccacgggtcgacaagatgctcaagaacgtctccgaacagcatgcagtcgaattgctctgattcgtacggaagaatggcggattcaatgtcgccgcaaagcacgtggctcaatttgctttccgccttttttgcggcttcgggatacgcttcaatgccgtaaaccgttattccgcggtcttcgatcgccgctcctaaattgcccgtgccgcagccgacatcaagcactgtccgccagttttcgtctattttgttcaataaataaggattcaggccttcgtagtagttctgttgtttttcatcataatagggattcgtatccatctgtgtatcacctcataaatgggcataatacacaagatatgcagcggggggatctcatatcaccatgtttggctgttcaattgcggaatgcggacgggaatggttgtccggtatacggtttgttctctgattcccctcttattgcgggtgttcctttgaaaactcgggtgcgggcggactgtggcaggtcatatagtaaaaggatccgcctgtaatcttaccgctggcggatggtgtttttcattggtgtttttttcttcaccgctttttcagtatttaagaagcgcctcacatcgtcaatgtgcaaacccatgattctagcctcttgaattaacaattgccaatcttgatctatatctttcattacatgagttttcataagaacctccaattgaaaaattgatttgcccagctacagcagccaatgtataacaaatatcacacatagttggccggtaatcccaaattgaagatgaattcacctacctattccctaagaaaatgactgaaataaccaaaatccttcaagaattcttacatataataataaacaaataaatactgactggatagtatgcaaataaaaataaaccatatgacctattaacatttaccctcaaaacgtcgattagcatattctttttgcataaaaaataccgcaaaagaatgattcggtgtaagataaagtgaatgatcaaacagctggggtaaaaaatgaaaaaaaacaaatttcaaattaagagagaagaaacatttgaaagttttattgacgcaggccttcatctcctgattgaaagagcttacgattcagtctcaatcgatgacatcagtaaagcggcgggtttcagcaaaggggcgttttacgttcattttgaaagcaaggaagattttctgaagcatttgttagagaggcgtcagattaaaaaaaggatcatcactggctatctcgacgaattagaaaagcaaacagagcggccgttgacgctttgtgaagccgcggccagcgcggccagcctgttgatgcggtttgtaaacagcaagcctgcctggaatgttgtgtcttttgccgttcatatgcctacttacaaagtcgtcagtgaatatgaagcttatatccgcctgtataagttatggatagaagaaagcaccatgtacataaattggctcaaatcgagaaatttaatagaagaccatatagataccgagcataccgctaacatgatgtgcgcgctcatcgacggggtgattaagcaatccaatgtgctgggaaggccggttactttccgcagcatgtttgacgcgctctatgtttttgtcagcaccagaaaatcagggtaacgttcttcttgatttgacaaaaggtttagaaaagtctttcagaaagcgaggaactgccatgcgctacagagaaattatgatgtatatcattatggggatattcacgaccatcgtgaatatcgtcagtttttacattctgacgtcggcatttgagatggattacaaggcggcgactgtcgccgcttggattctgtccgttctatttgcttatgttacgaataaacggtatgtctttcagcaaaagaccgcggggatgcggagtctgatgaaagaattaacggcctttttcagcgtgcgggtactgtctctcgccatcgatctcgccatgatgattcttctggtcagtcaatttcatatgaacgaaacattggcgaaaatcgccgataacgtcattattgtagtcgtcaactatgcggccagcaagtggattgtcttcagaaaagcgaaagaagagggcgtgtcataaccgtttctttccgcgtcccggggggaaagtgtaatggtggaaggggatgcgtttgaagcgcaaaataaagaaagcgtttgctgatgtattcggggaatccgagacctgcgctttttctttgcgcccggcagagtgaatctcatcggagagctaacgggggccgctatgaggagaagacagagagaaaagctgacttttacacggcggatatcggcgccggagcgagagaactaaagggggatgacgatggcaattgagcggcacgtggaacgtttaatccagtacggattgcaaaaagagctgatttcatttcttgatattgaatatacaagaaaccgtttatatgaaactttgcatattacccatccggaggcttcagaacagaaagaaaatgaatcggcggcatcattgccggacatattggccccgatttatgaatgggcggcagaaacgggccggattgcagccgatacagacacctatcgcgacctgctgagcgcgaagatcatgggctgctttgccccgcagccgtccgagattgtgcgtcgttttgaagaaacaaaggcggtgcacgggccggagcaggcgacaaaggcgttttaccgattttcagaggatgtgtattatatccgttcggacagaatacagcggaatgtcggatggacggctgagacggcttacggaaagctggacatcacgatcaacctttcaaaaccggaaaaagatccgaaagcaattgccgctgccaaagagcagcctcaatccgattatccgggatgtgttctttgtaaagaaaatgtcgggtacgaggggagaccggatcacccggcgcgtcaaaaccttcgtgtcattccggtcattctcggcgatgagcagtggtttctgcaattttctccgtatgtgtattaccgggagcattgcatcgttttgaaagaccggcacgaaccgatgaagatcagcaaaaaaacgtttgaccggctgctgtcgttcgtcagccagtatcctcattattttctcggttccaatgctgatctgccgatcgtcggcggcagtattttaagccacgaccattttcaggggggccattatgaattcccgatggcgctggcggagacagaaagctggtacaggctgcctgactatccgaaaacggtgctgggaattgtgaagtggccgatgtcggtcatccgcctgcagagtgagtgcgcgtctgagctttccggcgcggcggatgccatcctgcgggcatggcgcggttattccgatgaggcggctgatctcctcgcctgttcaggagaaacaccgcacaatacaattacgccgattgcccggcggagaaacggtttattcgaattagatctcgtcctcagaaataaccgcacctctgatgagcatccgctgggaatttttcatccccatcaggaagttcatcacctgaaaaaagaaaatatcggactgattgaggtaatggggcttgcgattctgccgggccgccttgaacaagaaatgaaatacacggctgaagcgctgtgctcaccggacccggaggcggtcttaacggcagacccttctgcggcaaagcataaagattgggcgctcagtgtgctgcataagcggaaggtaacgaaagaaaacgcggaacagattctgaaagaggaaatcggccatgcctttgcgcggatactggagcatgccggcgtctttaaacagacagaagaaggcagagcggctttccggcggtttatccgccatttgggcgctctaccggaaaaaagccccatcccataagggacgaggcttttttttatcctctgcttctggcgatcaggctgaataagaataccacgatcgcagctccgatgattgccggaatgatggcaaagccggcaaggtgaggcccccatgtgccgagcagtccgtgcccgatccatgcgccgatcagaccggcgatcattgacccgatgattcccccgggcatactgccttttacaaataaacttccgatccagccgataataatagcgacaatcagagatacgataaaacccataaatatcacttcctattttttattatttatgcctatatgtttccttcgttttgtccatattaaacatatgaatgcgttttttataatgaacatatcaaggcgcgttccggtcttttttttcacaatgcgttgcgttaaaatggaaaccgtgtgaaaaggtgtgagcaaaggaaaaaatatttcttttgtagaatgtttaacaaaatgaaactttttgttgaccagcgatttttattatggtaaacctttatttggtattattcgttctcgctatcttttttctctatatatgctaaatgatctaaaactttttatgtttgatttacgcaagtggaaaaagctcatgcattttttgacgattttgtgacattaggtcgaaaaaaagatgaactttagaaaaaaataaagctaataagggcagattttgatagcataacaaggtagatagagaaaagattttgagaaagtacatttcagattcactacatcaataggaaggatggtgatcttcttgttcagagcatttaaaccgttacttttattagcgatgttggctgttgttttcgtactgggcggatgcagcgacatttccgttttagatccgaaaggacctgtagcagaccagcagaaagatctgattctcttgtcaatcggatttatgctgttcattgtcggcgtcgtattcgtactatttacaatcattttagtgaaataccgcgaccgcaaaggcaaagacagcggaaattacaagcccgagatgcacggcaacacgttcttagaagtagtctggacagtgatcccaattttaattgttattgcactttctgtgcctaccgtacagacgatatattcgttagaaaaagcgcctgaagcgacaaaggataaagagcctcttgttgtttatgctacttcggtagactggaaatgggtattcagctaccctgagcaggatattgagacggttaactacctgaacattcctgtagaccgtccggttttatttaaaatttcttcagcagattcaatggcatcgctatggattcctcagcttgggggacaaaaatacgcgatggcgggaatgctgatggatcaatacttacaggctgacaaagtgggaacatatgaaggccgcaacgcgaacttcaccggcgaacactttgccgaccagaaattcaacgtaaaagctgttacgcaaaaagactttaacagctgggtgaaaaaagcccaaagcgattctccaaagctgacgaaagagaagtatgacgaactgatgcttccggagaatgtcggaaaattaacgttctcttctacacacttaaaatacgttgaccacggccaagatgccgaatatgcgatggaggcgcgcaaacgccttggctacaaagccgtatcaccgcactctaaaacagacccgtgggaagatgtaaagaaaaacgaatttaaagtatccgacgataaacaagattgaaattgaacaagaaaggaggaagcccgaatgaaattgagatgggatgaattttttgtaacaggtgacccattaattctgggcgcacaagtttccattgcgctttccactatcgctatcatcgttgtactcacatacttcaaaaagtggaaatggctctggtctgaatggctgacgtctgtagaccataagaaacttggaatcatgtacattatctctgctgttatcatgctgttccgcggcggggtcgacggcttgatgatgcgcgcccagttagcgcttcctaataacagttttttagactcaaaccactataatgagatctttacgactcacggtacgatcatgattatcttcatggcgatgccgtttttaatcggtctgatcaacgttgtcgtacctttgcagatcggtgcgcgcgacgtagcattcccttacttgaacaacctgagtttctggacgttcttcgtaggtgcgatgcttttcaatatttctttcgttatcggaggttctccgaacgcaggatggacgagttacatgccgctggcaagcaacgacatgagtcccgggcctggtgagaacttctacctgctcggtcttcagattgccggtatcggtacgctgatgacgggtatcaactttatggtgacgatcctgaaaatgcgtacaaaaggcatgacgctgatgcgtatgccgatgttcacatggacgacgctgattacaatggttattatcgtattcgccttccctgttttgacagtggcattggcgctgttatcatttgaccgtttgttcggcgctcactttttcacgctggaagccggcggtatgccgatgctttgggctaacttgttctggatttggggacaccctgaagtatatatcgttatcttaccggcattcggtattttctctgaaattatttcagcgtttgcaagaaagcagttattcggttacaaagcgatggtcggctcaattatcgccatttccgtcctgagtttccttgtatggactcaccacttcttcacaatggggaacagtgcgtccgttaactctttcttctcgattacaacgatggcgatttcggttccgaccggggttaaaatctttaactggctctttacgatgtataaaggccggatcagttttacaacaccgatgctgtgggcgcttgcgttcatcccgaacttcgttgtcggcggggtaacaggggttatgcttgcgatggctgcagcggattatcaataccataatacgtacttcctcgtatctcacttccactatgtgctgatcgcgggtacggtatttgcatgtttcgcaggatttattttctggtatccgaaaatgttcggccacaagctgaacgaaagaatcggaaaatggttcttctggatctttatgatcggatttaatgtatgtttcttccctcaatacttcttggggctgcaaggtatgcctcgccgtatttacacttacggaccgaatgacggatggactgcattgaactttatttcaactgtcggagccttcatgatgggtgtcggattcttaatcctttgctacaacatctactacagcttccgctactctactcgcgagatcagcggagattcatggggcgtgggacgtacgcttgagtgggcgacttcatctgcgattccgccgcattacaactttgcggtgcttccagaagtgaaatctcaagatgcgtacctgcaattgaaagaagacaaaacggatattcatccggaaagcaagttcaagaaaatccatatgccgcacaactccggaagaccgcttattatgtcagtggcgttcggtattgctggcttcggacttgtatttgaatggttctggatgggcattgtcggcttgatcggcattctgctttgcatggtgcttcgttcatttgaatatgacaatggctactatatacctgttgaagaaataaaagagacggaaagaaagatttccgaataaaggaggcgtgatttatggaacatgcagaacacggcaattctaacgcgcctatggaatatcaatctgaaaccggcagactcaatattctcgggttttggatctttttaggggcagagattgtgttgttctcaacactatttgcaaccttcttcgttcttcaaagaagaacagcaggaggagtcttaccggctgaattatttgaagtgaagcttgtcatgatcatgacattcctgcttctgatcagcagtttcacctgcgggatcgctgttcatgaaatgcgtcgcggaagtttaaaaggcgtcgtcatttggacgatcattacgcttcttctcggtgcgggcttcgtcggatgtgagcttaacgagttcatccactatgtacatgaaggagcatctctcggtacaagtgctttctggtctggattcttcgtccttctgggaacgcacggaacgcacgtaacgatcggtatcttctggattgccggcatcttactgcaattgaagaaacgcggattaacgccgcagacgtcttcaaaaatctttatctcaagtttatactggcacttcttagacgttgtttggatcttcatctttacaggcgtctatctcatcggattggggggactataatatggcaaacaaatctgctgaacacagccactttccgtggaagcatatcgtaggttttgcgttgtctattattctgaccctgctggccctttgggttgcggtatatacggatttaagctcatcagcaaaactgtggatcattttcggattcgcatttatccaagccggtcttcagcttctcatgttcatgcacatgacagaaagcgaaaacggcgggattcaagtcggaaacacgctcttcggatttttcggagcgattgttatcatccttggttccatctggatctttgcggcgcactaccatcacggtgaccatatggatggaaaccctcctggcggtgcgaagcaacattccgaacatcaggaataaaaagaaaccctcttcgttcaggcgaagagggttttttgtgcctttattggcttcttctccggcgcaggcgcggaaggccgtaaatgataaaggcggcgatatgggcaacgatgacgttgacggcaaacaggatgatcatgagtgtgtggccgagaggggacaggctgctggttgcgtaaaagtagaagaaaacccacatgagaataattggcggtatggccgaaagagcgacttttttgttatccagccagataaagaggggtgttgcgcttgcgaccagtaaataagcaaaaaacatgtccatcttacatgtctcctttcattttatgggagcgtttccaaaatgaaatacagagaataaaatgtgtctgttttgtggtcgttttttgaacattttgttacaattattataccatgttttccaatttttgataccgctttatcgagaaatgtattgcaactattgcctcatttttggataggtacaagaaaccggaaaggtcaaataccctgtcacatttccggacaagggaatggcgcaggctgtgaacctttgctatgttcaaagaaaacatgcacagcgagggtggttttgaagtggacataacaaaagacgatgtcacagcgccggacgtcattgcgcttttgcaggagcatctgaagagcatgaccatgcattctcccccggaaagtatacacgcgctcaatgcggaccggctgcgtcagcctgacgttacgttttggagtgcgagggaaaacggcgtcctgctcggctgcggcgccttaatggagctaaacagccggcacggtgagatcaaatcaatgaaaacggctccgcatcatgtcagaaaaggcgcagccaaccggatcctccgccatatgcttgaagaagcaaggcggcggggctatcagcggatcagcttagaaaccggttctatggaggcttttctccccgccagacgcctgtatgaaaaagcagggtttcaatattgtgatccgtttgcacattataaagaggacccgaacagcttgtttatgacgttaaacatagactgaaaccccttttctgacgagaaggggttttttatcggaaaagtttcatcatgaccgaaacatttccttttctgacacgtcatatgtcgtgtagtccccaaaccgtaaaaaataaaaaggaagcaacctcatcatgttttcttgaacggtgttcatgtataataaacaatagtgacttccgatgaaaatgtaaggcgggatagaatgagtcgatataagaaacagcaaaatccctattatcagggggatttgatttttatatttggtgtgtttttaataattagtgttgcggcgatttatgcggccggacagttcgggcagtatggaggcagtgcctggatgaaacagattgtcttctatgttataggtgcgggattcatcggattattgctgtactttgatttagagcagcttgagaaactgagtctgtatgtattgattgccggcgtgctgtcgctgctccttttgcgtgtggcgccggaatccatcgcgccgatcaaaaacggagcgaagagctggtttcaaatcggcaactttaccctccagccctctgagtttacgaaaataggaattatgatgatggtcgcgtccattatatcgaaggcgggcccgaaagatcaaagatcacttcgggaagatgtcaatctgcttttgaaaattgcggcatggacggttattccaattgggatgatcgttttgcaggatgccggaacgggtgcgatctgtctgtttatcgttatggtgatggtgtttatgtcaggtgtaaactggaagctgatcaccatcatcggcggttcggccgcgcttgtgcttggcctattcttagtgcttgtaattgaatttccccatgtggcgaattcgatcggtattgcggattatcaaattaaccggattacatcgtggatgtctgactccagtgcggcaacgactcaggccgagagcgataaaagctggcaggtggatcaggccgttatggcgatcggatcgggcggcattaccggaaacggcgttcataatctgaaagtgtacgtacctgagggacagaccgactttatctttgcgattttgggtgaaagttttggatttttaggctgcgccattgcggttgtcatgtttttctttttaatttacaggcttgtggtgctgattgaccgcttgcatgcgtttaaccgatttggtgcgtttttttgcgtaggatttactgcacttatcgtgattcacaccttccagaacatcgggatgaatatcggcattatgccggttaccggtattccgctgctgtttgtcagctatggggggagctcggtgctttctacattaatcagcttcgggatcgtatataacgcaagtgtgcagctgacgaaatataaaagctacttgttcaattcttaatgtgagacggctcgtttttcgggctgtctttttttgtttagagcatttcgcttttggcatgatactctttcggatatgatatatagagaaggaggctttatatatgaacaataccatcgaaaccatacttaatcatcggtcgatccgatcatttactgacgagcttctgacagcagaagagatagatacattagtgaaaagcgcccaggcggcgtcaacgtccagttacgtgcaggcttactccatcatcggcgtaaccgataaggagaaaaagcggaagctggcggcactggccggaaaccagccttacgtcgaaaataacgggcacttgtttgtgttttgcgctgatttgtaccgccataaaaaacttgctgaggaaaaaggagaaaacattaccgagcttcttgagaatacggaaatgtttatggtcagcatcattgatgccgcacttgccgcacaaaacgtaagtgttgccgcggaatcaatgggactcggcatttgttatatcggaggcattcgaaatgaacttgatcaggtgacagaagtgcttggtacacctgaccatgtgctgccgctgttcggcttggtagtcggtcatcccgctcatccgtccggtcaaaagccgcgcctgccgaaacaagccgtatatcatgaaaacacgtacgatacgaatgaagaaaacttccgcagttatatgaaggaatatgatgaaaccatttccgattattatgataaacggacaaacggcaagcgggttgaaacgtggtctgatcaaatcctgcagttcatgaaacaaaaaccgagaacctatttaaatcaatatgtaaaagataaaggttttcaaaagaattaagaaaaaacctctcctgaccgggagaggtttttttatgtttcacgtgtaacatatttcgacaaaatggaacaaggtatataaatgtttatcatcagggatgctgataagcatacagaaagaaaaaacggcttagcagtggtacgatgttgatgaggtgacagtgatgatttcattaagtatattggatcaatctcctgtatcagaagggtgttctgcggaaagtgcactgcggaatacagtaagattggcgcaggaggcggaaaagctcggatataagaggttttgggtgtcagagcatcatttttcagagcggttggcgggctcaagccctgaagtgctgatcagccatattgcggcgaaaacgaatgacattcgggtaggatcaggcggtgtgatgcttccgcattacagcgcatataaagtggcggagaatttccgcgtgctcgaagggttgacgccgggcagaatcgatctcggattagggagagcgccgggcggaatgccgatcgcatcatgggcgctgaatgacggcgggaagcgtaatgctgatcaatatccgcagcagcttcgtgagctggcgatgtatttgcatgatgcagctgatgacaatcaccgttttccgaatctgaccgcatcaccccttattaagacggcgccggaagtctggcttctcggttcttcgggagaaagcgcgtttctgagcgcagaaatgggagcaggctatatgtttgcccattttattaatggagaaggcggagaaagcacgacagcacaatataagcgcagatttaaaccttctgcattaggtaaagaaccaaaaacggccgtggcggtgtttgtgctgtgcgcggatacggaggagaaagcggaggaactcgcggctgtcatggattatacgctgcttgcgggtgaacaggggattccgcttcacggcgtaccgtcttacgaaaccgtccgcggcaatacgtatacaccgtatgaacaaagacgaattgccgataatcggaatcggatgatcatcggaacgaagcagcaagtgaaagaacagattctggctctcagtaaagcatacggaacagaagaagtgatggctgtaaccattactcatcattttgaagataaacttcagtcataccgtctgcttcgagaagcttttgccgattaatcagaaagaaaccctgctgatgctccagcagggttgttcggttattcaatgataaaaggtttttcagtcagcacctggcttgatttccctttgttcgcggcataggccagcatataatattctcctgccggcagtgcggtgtcaccattgactttgccgttccagtcgaaatattgatagcctttatcctgctttttgtagatgccggcttggccgacaaagtcaagattactgtcatatacaaggaaggcaagctcttcggctccagccggaagataggtttcaatttggtaggttccctgcgttgtgccgtcctgtacgtcgattgacgttacgcgcggatagtccggctcttttacaatcagcagcgtcggcacttttgcgactgtttttccgccttcacgcactgtgacggttccctcataggtgcctgcctttacttttttggcattgacctttactttcgcattgacctttccggtttgatgagcggggatcacgacccggtctgtgcccgaaacggtaatgcccgtgccgttgaaagagtactcgagctgatatgattttctgatggacgattggttttcaatcgtaaaggtttcttttttcgtttcattgcctttgtctttcataaacgttccgtaagaataacttcccggggcgacaagggagtctgctttgatcgccttcatgattctgatgcttccggcgccttgcgcattatgcgggtatacgtcaccgtccgcgtccgttaaggtttccgccgtgttcataagagcggcttttatttgttccgggctccatttcggtttggcctgcttgatgacggcagctgcgccggctacatgcggggaagccatgctcgttccctgcttcgatccgtagccgtacgggtcggccggatcatgggtcggaatggtgctgacgatgtttacgccgggagcggagacgtcaggtttaatcatccacgtgtccataaccggaccgcgtgacgaaaagtctgccatttgttcagtgagcgatttagccacggataaatggaatgtcgcttttgtgccgcccgcttttaattggctgacgagtttttcgccgtcttctgatgaaagcttaaccgtcggcacggacatgcccggtacgttggcttcaatttctcccggggcattgttatacacaaccataccgatcgcgcccgcttttttggcgttgtctgctttatccacaaaggcgatgctgccccgtttgacgaccgcgacttttcctttcagatctttgccttcaaaatccttttgctcgccgatacccgcctctatgagctctgtttcttttttattcagtgcttttatgtcatcttctttgttgtaccccattactttcgctgaggaataggaaccgaaggagacggcgtactcgttcagcggcagctgtgtcgctccgacggagatagcttctctggacgctcccggagagccgacggtccaattgttcggcccgctgtttccgtttgatgtaacggccgtgacgccttctgacatcgcccagtcaagcgccgtgcttgtcgcccagtctgggttattcacagaattgccgagagaaaggttcatgacatccgctccgtcctgtacggcgcgttcaataccggcgatgacgttctccgttgttccgcttccgcccggaccgagcacacggtaggcaaggagtgtagcatccggcgctacgcctttaatcgttccgtttgccgctaccgtgcccgcgacatgggttccgtggtcagtcgacgcgcctctcggatcaccggacggcgtttcttcaggatcgtaatcgttatccacaaaatcgtatcctttatattgtccgaaatttttctttaagtcagggtgtttatattcgacaccggtgtcaataatggcaaccttgacgcctttccccgtatagccgagcttccacgcgtcatttgcccctatataaggcgcgctgtcatccatctgcggagacacggcatccttagatagggtgatgtctttatctttcagttgatcggtatgataggtgacgttcggataaaccgctttgacatcctgatcactcagcagtttcggaatttcatttgccgggagtttcatggagaagccggaaaacacttgctcatattccctgttgatttttccgtgtttaatggttttgagcgctttctttttcacttttgagcgttcgcttttcagcttgctttttgtctgtgctttgccgagttcctttgcttccgccagtgacttttccttcagctcgacgatgactgtcgtttgtttgccggtggtcatatcaatgtcaccaaatacctcagccttctcaagatcaggagtttgcggttttgaagccggcgcagcctgtgaacttgtggataaggtaaaggataagacaaaagccggaagcagataacggatgattccttttttcaatcgtgtttccccctttttctttatctaaattagaaatctagtatatatttcttgaaaattcaaaataatccttgtgacatatgactcatttatggaaattggtctgtgaataaggagggagttatacacagaatcctgtgcataactgaataaaattgtgtatatatattgttgggaacgagtgttcccatacaaaatatagatcgagtttgtggatatgtggatataccctgtgtttaagctgtgcttaaccaagggataaggtgtgtataactttttttatcggcttttccatttttcaggtcatttccatcagctttcaacaaaacttctgaaaactagtttgttttttcactcatattgtgacaaacaattcgcccggccgcgtctatcatagagtcatagggttgctagacccgctagtttttagcggagaaggatcggccgccttttccgttaaagcggagagaaaaacaggcctgcgaacaagctgtctgtcaaaaagaagcggagggatgatttgcaatgaaacgtttgctagtatctttacgggtgtggatggtctttctgatgaactggatggcgccgggtaacggaagatatccattagccgccgtgtacggaaaccaagcggcttatcataagaaagcgaagcggacggctggtgctttttcgtttgtgagccgagtccgatcggcggatttgaccgatgaaacgaaatcggcccgcggcaggctggataaaaaccgatggatgcctgtccgcaaagaattgccgaaacgggagcgcgcgggtccggcacctttacatcatatgaaaaagagggtacaatcccactaaacatatgaacgggagcgaacctcttgagaatagacaaagtattaaataacaatgcggcgttaataaaagaagacggacgggaaaagatcgtaatgggtcccggaatcgcttttcaaaagagaaaaaatgatgtgattcaaaaacataaaattgaaaaaatatttgtcgtgcacgacgaaaatgaaaagttcaaacaagtgttagaaacgcttcccgaagagcatatagaggcggctgaagatatcatcagccatgcggagggagagcttgcggcgcctttgaacgatcacatccacattgcgctggcggaccatttatcctttgcgatcgaaaggattcaaaacggccttcaggtgcacaaccgattgcttcatgaaattaaggcgctttataaaaaagaatatgaaatcggccgctgggcggttgaacacgtgaaacaaaccctcggtatatcattgcctgatgatgaggcggggtatatcgcgcttcatatccacactgccaaggcggatgccaaaagcatgtattcggcgatgaagcatacaaccatgatcaaagaaatgatcgaaaagatcgaatcctttttcgaacagaaggtggatgaagacagtatttcctatcagcgcctcgtcacgcacttacggtatgcggtcagccggttggactcaaatgaagcactccattccatggacgaggagatgctttatttcatccaaaaaaagtatccgtttgcttatcggtgtgcgcttgaactggcggcgtttttaaaaaatgaatatgatttggaactgccggaatccgaggccggctatattacgctgcatgtccagcgtctgcaaaaaaacccggaataacgcgtctgtttcgagaaacagactttttttttgaaaacatattgacgaaagcgctatcatgaaataaaatgaaagcgcattaaaaaactgaatcggcgggattgtgactggtaatgcaggcaagacctaaaatttgcgtacatgaaaaagggatcatgctgacctttttcgttggcgaattttaggtcttttttgattttagaaagggggatacatcatgaattatcaagaaacggcaaaacagcttatcaaacatatcggagggaaatcaaatatcatcagcgcgacacattgcgccacacggctcaggctcgtcattcaagatgaacagaagatcagccaggccgatattgaagagacagaaggagtaaaaggggctttcagcagctcggggcaatatcagattatattcggtaccggccttgtgaataaagtgtatgacgctttttcaaaagaagccgatttggggcgggaggatcgtgagacacatcaggacgcggcgaaaaaaaagctgaatccggccgcaagatttgcgaaaacactgtctaacatattcgttcccatcattccggctatcgtggcaagcggacttttaatggggctgctcggtatgatgaaggctttccactgggtgtctgaacaatcatcgctgtttaagcttttagacatgttttcaagcgcggcgtttatcttcctgcccgtattcatcgggttcagtgcggcgaaggaatttggcggcaatgcctatctcggtgccgtgctcgggggattatgatccatccggcgcttttgaatccgtgggggcttgcggatgcatcgcctgattttatgcaactcttcggcttcgacattgcgctgctcggctatcaagggacggtcatccccgtactgttagccgtttacattatgagcaaagtggaaaagggcacgagaaaaatggtgcctcacgcattcgacttattggtcaccccgtttgtcacggtgattgtcacaggatttatcacctttatcgcaatcggtccgcttggcagggcgatcggatcgggcattaccgtctcgctgacatatgtgtatgatcacgcgggcattgttgccggacttcttttcggcggtctttatccgcttattgtgctcaccggtgtgcatcacagctttcatgcgattgaggccggcctcatcgctgatttgggcagaaactatatccttcctatctggtcgatggcgaatgtcgctcagggcgcggcgggactggctgtatttttcctgacgaaaaaagcgaaaatgaaagaaatcgctctgcctgccgcattttccgcttttctcggcgtaaccgaaccagttattttcggtgtgaacctaaggtaccggaagccgtttatcgcgggaatgatcggcggagcgctgggaggggcctatgtcgtggtgaccggcgtcgccgccaatgcttacggtctgaccggaattccgatgattgccatcacggctccgctcggtttaggaaatcttataaactatctgatcggaatgggcatcgcctctgtctcggcgtttattgccgcttacattatgggagctaaagaaaaggaggccgtcaaatgaggacaccggatcaagagctgcgcctgcaggctgaggaagcgaaaaagaagcggcaagaaacagccgcgtcagatccataccgccagaactatcatgttatgccgccggtcgggcttttaaatgatccgaacggcgtcatccaatggaacggcgtatatcacttgttttttcaatggcagccatttcatacggggcacggcgcgaaattttgggcgcatgtgacgacgaaagatttcgttgagtggaaagaggaagaaatcgcgcttgcgccgggtgagtggtatgacaaaaacggctgttattccggaagcgccatcgaaaaagacgggcggctctgcctgatgtacacaggcaatgtccgtgacggagaaggaaatcgggaaacgtatcaatgcctcgccgtatccgaagacgggatcgtatttgaaaaaaaaggaatcgtcgtgcgtctcccaaaaggctataccgctcatttccgtgatccgaaggtttggaagaaagacggagcgtattacatggtgctcggcgcgcagacagaaaagctcaccggaagcgctgtattgttcacatcagagaacctgacggattggacgtttctcggttcgattgcgggggcggactcgggcggtctcgggtcattcggctatatgtgggaatgtcccgacctgttttctcttgacggaaccgacgtgctgctcgtatgtccgcaggggcttgaagccgacgggataaaatatcataacagccaccaggcgggctatttcctcggcaggctgcatacagagccgccagaatttaagcacggtgaatttacggagcttgacagaggatttgatttttatgcggcgcagacgctggaagatgataagggacggaggattctgttcgcgtggatgggcgttccggatcagcatgaggacaagcatccgacacatgcgtatcactggattcactgcttaacgatgccgagacagctgtcactgtccaacggcagaatcatacagcgcccgctcccggaaatgaaatcgcgccgcacggatgaacaaaagcgccgtcttcaattgaattgctcgtctgtaagcctcccggtgaaagatgcgtcccgggctgaagtgctgctggaagacattacttgcgaatccggttttgaaatctcaattcggggcgcggcccggtttatatttcatcaggaagaggggctggctgtgctggagcgcaccgctttcagcggagaagaaaaagaaaagagaagctgcgccatcagcgagctgcattccgtccagctctttctggatgcatcctccattgaattgtttttgaatgatggagaagaggtattcagcgccagatattttcctttcccgggaaatgatgacgtaaccgtcacttcggttgggaaaacggaaataaatgcctcaatttggacacttttgtagaaaatcgttcttttttcttatgtgaaacctatgccatctgtgctattcttcaaacgaaagcctatgattccaggaataaaaggagttgttttctcagttttgaaaaatcagaagatgacgccgaaatgtttacttgtcaaagctgcagagcaagtggaagataaacgggaagaatataaagaagtattgcttcagctgaatcgcatgctcaagagggctgagccgcacaatgaatggagtgatcggctgaggcatacatatgaacagatgaaggaatatgcgctgtttgtgcaatcgattgagatgtttttgcggtcatccgcgaaaaaaatgaaataatcccctcgatcatgagggggatatttattttattttccgctaagacgcatcgccgaatgtttagtcggtccgatgtattggttcagcgggaaggattctttgattgccgcagtgataaattcttttgccgcatagatggcttccttcacttcagcgcctttggccagttctgccgtcacggcggcggagaatgtgcatccggctccgtgcgtgtaaggtgtatcaatcatttcgctttctaatacttccgcggtttctccgtcatacagcacgtcgatcgctttttcatgtttcaatttgccgccgcctgtaatcaatacatatttcgcgccgagttcgtgaattttcttggccgcttctttcatgtcttccaccgtttttaattcatccataccgctcagctggcttgcttcaaacaggtttggcgtgatgacggttgccagcggcgccaattgggtgcgaagcgcttcggcatgctccggatacagcacttcgttcgctcctttgcagaccatgacaggatcaataacgacattcttcagctgtttttctttaatcgttttcgccgcaagctcgatgatctccacggtagggagcattcccgttttcatggcgtctacgccgattccgtcaacaatcgtcgccagctgtgcgcgaatcgtatcggcatcaatcggaaatacttgatgatcccagctgttctccgggtccatcgctacgatcacggtcaaagccgtcattccgtatacgtttttttcttgaaatgtttttaaatcggcctgaattcccgcgccgccgctggaatcagaaccggcaatagtaagtgctttgtgcattgacatatcaatggcctccatcagtgttttatatctcattatagttagattttctcccgatcacaatacggaaggcttggaggaatgatttgacagccgcggggatgtgcgtacaatacctacataagattactaggtaagggtgagaaaataaatgctcaacagggagcttgtaaagggaagcacggtcattctggtgctgacgctgctgaatgaacggcccatgtacgggtatgaacttgtgaaagaaatggagaaaagaagcgggaatgaactgcaaatgaaggaaggcacgctgtacccatcgcttcataagcttgaacgccaaagctatatttcttcttactgggaaaagcagaccaaagggcccgaccgaaaatattaccggatcaccgatgaaggaaaaaacattctagccgaacggacgaaggaatggaatctgttctccgctctgatggaccggatgctgaagcggggcgggcagaatggataaagacctttatgtgcacgaaatcagaaaagggctggaaggcaaggccggaagccgtgaattattaaaggaaatcgaaagccatattcatcatgccatttgtgttcatctggaaaaaggcaaaaccgaaagcgaagcgatggagcttattctgcgggaagtggggactccgtctgagattatctctgcttttcaaaaagcttcgacggtgcccgcgcggacttttatgctcttttatctgttctgcaactgcggtctttttgtgatgggggcgatgattacgatgatgcacgcgtggaggattcatcccgcagttgacgcgctgtggaaagggatttccgtgtcagtatggctgattatgatcggttatgtgctgtattggttccaaatcggctatcaagctggcaaagagttcggggctggcggcaaaaagcttgctgagcggacggtatgggcttcaatggtgccgaatctatgttttatgtttgtctttttgttcaatctggttccggctgggctgtttccttcggcggtcacaccgagttttgcggcagtatgcgccgttgtgacggtatgttttccgttttgcggcaaaataggtttttacgcaggcaggcagagacttgcctgatctttttcactatatacatagggaatctatataggggtgtttatatgagattaggttcgtggatgtacggcgcgtgcgcccaaatagccgttaccgtatttaccgtctgcggcttggttcttgccttgcccgttgtgagtctttttattatggttctgaatgggatgcaagacgctacttttgttgttttcagtattttgcttcttctattgttttatgcgctgggatggatttgggctgtttcgtttgcgcgtgagtggaaggtgaaacttttcgagctgcaggtcagctcgctcattccgctggcgggtatattatacttgtacattgacagcggggtgagtataccggaactgattcatgattggcatgaggatggatgtgcgcttgtcccgccggcttttgtctgcttgtgcacatgctatgcgatggtgttggtgcctgtttatcaatcaaaactgtggaatgccatggaggcgggcagacttaatgccaaggcggtatgcactgtttggggagaccttctgatcattctggttttgctggcggggatgacgtggatttgtttctgaatgggccgaaatcaaaaatccccctgatctctccgccgctttatgttttaatagaacatgagaaaaagcagaaggagcgggtcatgaatatatcaattgtcatagtcacgtataatcggattccggctttgtgtgagctgctggagtcgatttccaggcagaccataaagccttatgaagtgatcatcgtaaatgatgccggggaatcggtcgaacaagcgaagcagctgtacagcgatctgccgattcagattattgatttagaacagaatgccggacatgtggaagcgcggaacgcaggtgtgaaaaaagcgtggggtgattatatcatgctgtgcgatgatgatgatttcattacgccgggccatttggaaagaatgacggctgcacttgctgatgcggattttgtccattctgacgcggaaattgtgtcatttgaagaacggggcggcacgagatacccggtgtcacgaaagccgttcgcctatacggcggattttgcggatatgcgggtattttccacgtacgttccgtcaggcagcatgtacagacgttctctgcatgacacgttagggtattttgatccggatgtccataattattgggactgggacttttatttgcgcgccgcgaaacagcaccgtgtgaagcgtgttccttgcgcgagcgtcatatatgcgttttttgagggaggcggcaatcagtccgcggatctcggcggcaaacggaagcggtacttagaccggttaagcgaaaagcacgggcttggggagctcccgacgaaaaacttcgcggttcttctagaagagccggacatgaagaggcgggaggcgccgactgacattgtgtgggacggaaagcccgtccattcaagactgcacagttcataagggggacggacagtttgaaacagcttttaaaagacagctggtggaatcagctgaaagatgaatttgacaaaccgtattatcaagagctgagagagatgctgaaacaagaatacagcagccaaacgatttatcctgacagccatgatatttttaacgccttgcattatacgccctatgaggatgtaaaagcggtcattctcggacaggacccgtatcacgggccaggacaggcgcacgggcttagtttttccgttcagcccggggtcagacagccgccgtctttgaaaaatattttcatagagcttcaggacgatatcggctgccccgtaccgaaccacggatcgctcgtcagctgggcgaagcagggagtgcttttgttaaacacagtgcttacggttcgccgcggtcaggccaattcccacaaaggcaaggggtgggagcggctcactgaccgcatcattgatgtggtgaatgaaagagagaagccgattgtctttatcctgtgggggcgtcacgcgcagatgaaaaaagagcgcattgacacatcgaaacacattattattgaatcgactcatccgagcccgttttcggcaaggaacggttttttcgggagcagaccgttttcccgtacaaacgccgcccttgaaaaaatgggggagcagccgatcgattggtgcatccccgacctgccgcaataaacggttttttgaggcgcttccgcccggcggaagcgtcttttttgatgttccgggcggtatgccgtcagaaaaaataacaaactcaattctgcgatccgctcagaaatttgataaaatgcaggaagaagacaaattactgctggaggatttactcatgaacatacatatctctgctttaattcagaagatggaagaagaactgaggcaggcgaaaacggcgacccgcaccgaggaggtcaaaatgcacgcggccgccatccgctctctgtgtgatgtcgtgctcggcactcagacgcacaccgctccggcgcctgtgcagaatccgattccgaaagcggcgccgaaaccttccgcgtctccttcgacagacccgctgctgcttgaaaaaatgatgggcagcgccgggctgaaccaatatcagaaaaaagcgaaagacgaacgtgaggaagacggaaacggggattccattttcgatttttaacaggagaggttgattgacttgaaactgatactcgggggtttgcaatggacggcatttatgattgcggctgcgattgtagttcctgtcgccatcgcacaatcatttcacttgaaccatgccgattctgccgcattgattcagagcacattttttgtgcttggcgtcgctgcggtcatccaatgtctccagggacatcgtctgccgattaatgaaagcccggcaggcttatggtggggcgtatacacgatttacggcggactgacgggcacggtgtttgcgacattcggcgagacgctgcgggcgctgcagggggcgctgttattaagcgctgtctttttctttttgttcagcctttttaaagtgattgaacggctggccgtgctgtttacgccggttgtgaccggtgtgtatctgctgctgttggtcatgcagctgagtcagccgattgtgaaaggccttttgggcatcggctatttaaaaaacagcgtcgacggccttgtattcgggctcgcaatggttgtgacggcggcgatgttcatcatgtcccgatcgaatgttacgttcttaagacagtatgcgattctcctttcgcttgccggcggatggatcttattcgccgtcttcggcgctgccaaaccgattcaaataccggatcgcgtgattcagctgccggttctttttccgtttggaaaacccgtgtttgacagcggcctgatcattacgtcactcttcattaccgtgcttttgattgtcaacatgctcgcgagcatccgggttgtagaagcggcggtgaaaaaattcggcggcaccgttgggaaacggcgtgagcgtccggcagggtttgcggcttcgatcagccaccttttgagcgggctgtcagggggcattgcgcctgtgccgatttcaggggcggccggttttattgagacgacgaagcttccttcgaaaaagccgtttcttttgggaagtgtatttgtcatgatcatcagtatgatcccgctatttatgaatgcgtttgcgagtctgccctcaccggtcggctttgcggtaaacttcgtcgttttctccacgatggcgggtcttgcctttacggagtttgactcttatgagaaagcggagcaaaaacgaatccgttccattatcggtctggcgctcctcacgggggtcggcgtaatgtttgtgccggagagcgcgttatcagggatgcatccgatcctgatttcgctcttaagcaacggccttgtgctcggaacgctgctggcgatagcgattgaccgaatccagcttatcaaaaagaaaaaatccgacaatctcgtgtcatcggatgacggacgttgaattttgccgatgttgggttatgattgaattggaaactttaacgaaaaggcgggagaaaaatagatgaaagtgtttattattcttggtgcgattaacgctttattggccgtggcgctgggcgctttcggcgcgcatgggcttgaagggaaaatccccgataaatatttgcaggtgtggcacacaggcgtgcaatatcatatgtatcacgcgctcggtcttctggctgtcgcgtttttggctgaaaagctctctggcgcaggcagtgtttctgttgcgggctggctgatgtttgcgggcatcgttctgttttcaggaagcctgtacgtattgagcgtgacgcagatttccattctcggcgcgattacaccgctcggcggcgtggcgtttatcatctcttggattatgattatcgtcgcggccgtcaaatatttataaagaaaaaaagccaatcctctgtcaagtgagcgattggctttttgatttatctcggagaataagaagacatggagtacggataagtataagcgatttcctcatcaaatgtgatgtaatcaaggtaaatggtcagaagcagatagcgggtgcccgttttcggatcgctgatgatgatatggtcacgtcccgccgcctcaatcacaccgcggaaaatctttgaattccattctttgctgttttcgaatgtcatataaatcgtcgccgttttgccccggttcaaccgcagaatattttcaatgtatgactcttcaatcggcagcatgccgggaacgttttgtgacgatgatggacctgacgggatttgaaagctgccgccgccctgctgctgcggctggccggggaaccccccgccgaagccctgctggccttgctgcatcggcattgtcatttgctgctgcatcggcatcatttgtgatccttggccctgaggctgcggataaggattaggcccgagctgcggctggaatccctgcatatccattcccatccccatcccctgcatttgctgatattgattctttttcggtttcatattgttcctcctttgatgaaaacctcttgatgctgaaacctcctgacaagtatcagacagccgacagagcggctgctgtttttatctattccaccatatgagcccaaagaaagatttatgcgaaaaaagaaaatacgatccaatgtttccggatatcagagccggctttttttgtgcgcgcaatgctgacttttcacataatagtctgtatccctagcgcatcttccgcataaggaacatatgatagcggtagtttcaggtgcgaaaagggggtgacgagttgcctaaagtgtcagtgatcatgacgagctataacaaaagtgactatgtggcccgctctattaaaagtattctgtctcagacgtttacggactttgagctgttcattatggatgacaactcaaatgaagagacattggcggaaatacgtccttttctcacggatgaccgcgtccggttttatcaaagcgatgtatcgggcgtcaaagaaagaacggaaaaaacacgctacgccgccttgattaatcaggcaatagaaatggcggagggcgagtacgtgacgtatgcgaccgacgacaacacgtatgtgccggaacggcttgagaaaatggtgaaagagcttgatgaagacccggaaaaagccgtcgtgtattcaagttccaaaacctatcatctgaatcagcggaaagagacggtgaaggagacggccaggcccgccgaacggatcgtgtggaacgcgccgtgcgccattgaccattgttcggtcatgcaccggttttccgtgctggaacaggtcaaatcggcattcggttcctattgggatgaaagccccgcgttttaccgtatcggtgacgcccgttttttctggagagtgaatcatttttatccgttttacccgatttctgaggaacttgatatcaattatattaccgatcaatccatccattatcagcttttcgcggcggagaaaaacgagtttgtgaacagccttccgcagcagaccacgtgccgggagctgagggaatcattaaaaaagcttggaaaggggtgagggcttgtcggcatacttagcgaactattgggtgctgtaccggcagtatattgacctttttcagtcacttcgctacaaagacatcccgctcgcattgatcagtaatttttatcaatatatcagtccggcgcttcgggagagcatggagcagaacccggagcttttcggtccggcggatcagcatattcctgaagccggtattcagccttattatgatcaaaaaaggcaaaacattaagaaaacagatgagaaaccggtaaacggaaaagtcattctgcatttcgatcatcttcggttcaccgagggaaattaccggcagtttgatccggcaaaaacagcggtactggccagatggagtctgcctgaccatcatgggctgcccgttatctgcaaattggagctgacgggaatggggcaaaaagggaaccccgtcccttatattgaaaaagcccattccattttgaaagagcttcacagccatcccgctttcggaaacagagaatttcaggaacgactgtataaagacatcccgttatttattgaagcgattgacgccgttgatattttgtttacggccgagaagatttccgccgttgtagtcggcacgacggaggatatttacagccgtgtgctggcgctgatgtccgcgaaaaaaaacgccgtcagcatctgtcttcagcacggggcgctcatgggagatgaagcgtttctgcccgtatttacggactatcaggctgtattcggggcttatgaagcggagtggtataaagcaaaaggctgcagggaggaacaaatcatcatcacggggcatccccgtttcgacgagattttctcaagagagccgatagatcgggacacgttttaccgcaaactttcttttctcccgtcacagcggacggtgctgatcgccacgcagccgttttctgatgaattttatacgggagtgcttgaagagcttgccggccaaaagaacatgcagctcattattaaaccgcatccgtgggaaatcggcaaaaacaagctggatgcttacaatcaggtgctgcggaaatataaagcaggcaaaatcatcaaaaaagagatggagctgtatgatattctcccgtttgttgacgctgcggtgacacagacatcaacggtcggtcttgaagcgatgctgtttcaaaagcccgtgctgatcggaaaatcagcgggaacccgccgatacccttattatcattcacttggagaatttgtttttgaggacccgcaggcactcgctcaggaattaatccggatatgcgaaagccccgcagaatatcaaaaagcggaacaggcgcgccgtgcttttgtcgccgcgaactacccggttcaggattcgcttgccgctttatgtcaagtgcttcaggaaaaaaccggagtcagcttcagacgggttgacccttcataaaaaagataggagcgcaaaaaaaatggtgcaaaaaagatcagcttttcttccctattcattgcccatgatcgggaaggacgaaattcaggaggttattgatacacttgaatcgggctggctttcaaagggaccgaaagtagaggcgtttgaaaaagcctttgccgcctggacgggggcaaagcatgcgatcgcgctgaactcatgtaccgccgctttgtttttggccctgaaagcgaaagggatcggtcccggcgacgaggtcatcacgtctgccgtgacgttcagttcaacagccaatacaatcgtgcacacaggcgccgttccggtgtttgctgacatcgatccgcttacgctgaatgcagaccctgaaaaaattgaggcggccgtcaccccgcggacaaaagcgattgtacccgttcatttcgccgggcagtcgtgtgatatggatcaaattttggccattgccgaaaagcatcagttatttgtcttagaggatgccgcacatgccgtgtataccacttataaacagaaaatgatcggatcaatcggtgatgcgacggcattcagcttctacgcgacaaaaaacctggcaaccggtgaaggcggcatgctgacgacggacgatgacgggcttgccgatcagatcagggtgctcagccttcacggcatgagcaaaggcgcgtggaaccgctattcttcaaacggaagctggtactacgaggtcgaaacgcccggctataaaatgaatatgtttgatcttcaggcagcgcttgggcttcatcagctgaaacggattgacagcatgcagcaaagaagggctgaaattgctagccgctaccaggacgctttcagagacatgaaagggctcaccgtcccatatgtcagtgatgacgggcggcatgcatggcatctgtatgttcttcaaatagaggagcaggaggccgggatcagccggaacgatctgatttccgctttgaaagaccaatataatatcggcacaagtgttcattttattccggttccgttccatccgtattatcaaaaaacgtacggatataaggaaactgattttccggccgcggccgcgtattatcaccgcaccgtatcactccctctttatccgtcaatgacagatgatgacgttgaatacgtcattgcagccgttacggatatcgtcaaaggggctgattaggtgtacagactgagagaaaatcttgcacaggacatgattcatgccttcctgcatcagaagggcattcagcccgaagcctatgaatcgtcgctctgtttattggaagaaaacagccttcaaggcgtgattttatatgaaaactcttcgtgggaaagtcaattgttccgaaaaaatatcatcaatgtgaagcttgcagccgcaaacagcaccggacagctcaaaaggctgtttcaggaattttacgcggcaaggcgggcggacggcactgattttatatttattaaaataccagctgaagatatcggcgcgatgcaggtcgtgcagtcgcttccgaacgcttattttgtagggagtcttctcaagctcgtcagtccggtgcgtgtatataacagcacgccgccgtttgagattacagaagccggacccggcgacacggaagcgatcagccggctggcccgcgacgcctttacaaaaagcaggtattatcaggacccccatctcagctataaaagtgcaaaccgtctgtttgaagagtgggcgcggaataacgcggaaggcagagcttcgttacaattcctcgccaaatataagggagagaccgcgggctttgttcaggggctgtctaaaggcgatgaattcgtccttgatctgatggcggtaaagccgggatttgaaggaaaaggagcgggattccatttagctgcgcacgtgattgaacaatcattgcgctttcagcataagactgtatcagcgggaacgcagctccacaatgtaagagccatccgcctgtatgaaagaatgggatttaaagcggatgcgtccttttactactatcatgtgtggcccgggaaggaggcggactgatggcatcatgcaaaatcggaacgaagtcaatcggcgaaggttcgcccgtattcatcatcgccgaagccggaattaatcatgacggaaaactgagccaggcgtttgaattgatagatgcggccagtgaggccggcgcggatgcggtcaagttccaaatgtttcaggctgacaaaatgtatcagaaagaccccggcttatacaaaaccgctgcgggaaaaaacgtctctattttttctttggtgcaatcaatggaaatgcccgctgagtggatcgaaccgctgcttgaatattgtaagaaaaaaggcgtgctgtttttaagcacggtatgtgacgaaggctctgccgacttactgtatgcgacttccccttcagcttttaaaatcgcctcctacgagctgaaccatctgccgttattgaaatatgtcgcggggctgaagaccccgattatcttttccaccgcgggcgctgatatttcagatattcaggaggcttatcaaaccattaccggcgaggggaacaaagaaattgcgatcatgcattgtgtggcgaaatatcccgcgccgcctgaatacagcaatctgagcgtcattcccatgcttgccgccgcattcccggatgctgtgatcggtttctccgatcacagcgcccatccgtatgatgtgccgtgcgcggctgtcaggctcggagcgaaactgattgaaaagcattttacgatcgataaaaacctgcccggtgctgatcactccttcgccctcaatccggatgaattaaaagaaatggttgcggcgatccgctcagttgaagcggagctgcggcaggggcatcacgctccggtgccggaagtgctgtcgggaagctcccataaaacgacgacaccgattgaaggggatatcagaaggtttgcttacagaggcattttttcaacagcgccgattcaaaaaggcgaatattttacggcggaaaaccttgccgtccttcgtcccggccaaaaaccgcaggggcttcacccgagatattttgagcttttaactgacggcgcgcgtgcggtcagggatatccccgccgacacgggcatcacttgggatgaccttttgacgaaaggcagcccatatgatgactgacattttgtttatcattcaggcgcggatgggaagcgggcgtcttcccggcaaagtgctgaaaccgatcggcgggtatacgatcctcgatatgattgtcaaaagggttcgtcaaagtgcgttttacgatcaatcacgggataatctgatcgtcgccgcgtctgacagcaagaccgacgacattctgtctgcgcactgcctcagcaaccgctaccgtgtccaccgcggcagcgaacagcgtgtgcttgaccggtttgcacaagtcatcgaacaagtaaaaccggacatcgcagtcagactgacgggggataacccgtttgtcgacccttcgctgcttgattttctgattcaatcgcatttagatcagcacgcagactacacgtatatctgcggtacaccgctcgggatcggcggcgaggcggtgaacgcgcgccttttaacggagatcaatgcggacaaaacgctggcggacaaatatcaggagcatgtcacccttttgataagagaatcccctgagaggtaccggcttctctttcctgagcccccgcaggaactccgggctcctcacttgcggatgaccgtcgatacagaagaggactacaggctggcccgcgagctgtacgtaaaagcgggctcgcgtcctgatattccggcaaaagaattgatccatctgctgaatcgtgatccggagctcagggccattaatcaaatgatccggcaaaaagaggctgattagcgtgcgggttttgattttcgcggacgggggccgtgacatcggcatggggcacgcggttcggatgaagctgcttgccggtgccattaagaacaactgctcaataacgttctacacaaataaagaggcttcttcttatctatcatctgatcaatgggaagtgatcatcaagcctgacaagggacagaaggaatttattgtccgggaaataaacacgcgggctcccgaccttctcatattcgatctgctcgatatgccgtgtgactggctggaggaaatcaaaaagcattcatcggctcgtatcgtcttatttgaagaaaagagggaacatgtcattcatttatgcgatgccgttataaacggcatttacggcgggctgaaaagccggacggttcaaatgggcagcgccgcggtatatgaaggcccggattatatgattcttcatccgggttttgaaaaagcaaagcagctctatcagctgagaaaagaatgccgaaccatattggtctctttaggaggaagcgacccgaagaagcttgtctttaaagtgatggaagcatgccgccgcatccctgatattcagcggaaacgagtgatcatcgtcatgggcggcgcggcgcctcatgctgatgacgtgcgcgcgcatctcacacaaatgccttatgccgagatggtaaggcagacaaatgacatggccgcgcttctcacgagggctgatatggccatcgtgtccggcgggatcaccttatatgagaccatttgtacaggtgtgccctgcatcgttctttctcaagtggagcatcaaactgagacggcggaaaaattcgccgcacgagaggccgccgttcatctcggcctgggagaacacaccgcggcggacgtgctcgctcggcatatgtctgagctggctgctgattatccgagacggctcgggcttcatcagaacggaaagccgctggttgacggcaggggcattaaacgggcggcggcgattctttatgatttgtgataaaaccacacgtaaggaagtgttcatgtgaaaggtgttatcttagccggaggcaccggctcacgccttatgccgctgacaaaagcggtcaataagcatttactccctgtcggtccatatccgatgatttactggtcgatcatgaagctggaagaagcggggattacggatatcttgctgattacgcaaaaagaatatattccgcaatttcataaacttctcgaaaccggagaagagctcggcgtctcaatcacatatcaggttcagccagccgcatccggcatttccgacggtttatcatacgcaaagcggtttaccgggcgcgatccgttcgttctgcttttgggagataatatttttgaagattcattaaaaccttatacggagcgtttcgcaaagcagggaaaaggagcgaaagtgctgctgaaagaagttgacgatccggagcgcttcggcatcgccgagattgatgaggaaaacaaacggatcaagtcgatcattgaaaagccggagcagccgccgaccagactatgcgtcacggggatctacatgtacgacgcagaagtgttttcttatattgaacaaatttctccttcaaaacgcggcgaactggaaattacggatgtcaataatttatacattgaacacagtgagctgacgtatgatgtgttaacgggctggtgggtggatgcgggcacgcatgaatcgctctatctcgccggaagcctggcgcatcaggcattacagaaaggacaggagcattaatcatgccaaaatcatatttaattacagggggcgccggatttatcggccttaccttcacaaagatgatgctgaaagaaacagatgcgcagattaccgtcctggataatctcacgtatgcaagcaggccgcttgaaatagaagccttaaaaaagaacggccgtttccgttttatcaaaggtgacatttctgaaaaagaggacattgacaaagtcttttcccaaatgtatgacgctgtcattcattttgcggctgaatcccatgtggacagaagcataaatcaggcagagccgttcatcacaacaaatgtgatgggcacataccgactggccgacgcggtgttacagggaaaagccggcaggctgattcacatttccacagatgaggtgtacggagatttggcgccggatgatcccgcttttacagagacgacgccgctttctccgaacaatccgtattccgccagcaaggcaagctcagacctgcttgtcatgtcttatgtgaaaacccataagcttcctgccatcattacgagatgcagcaacaattacgggccgtaccagcaccacgagaaaatgattccgaccattatcaggcatgccgtaaacggcacgccggttccgctgtacggcgacgggatgcagatcagagactggctgtttgccgaagatcattgccgcgccattaagctcgtgctggaaaaaggaacactaggcgaaatttacaatatcggcggaggaaatgaacggacgaataaagagcttgcgtcatttatcatgaaggagctcggtgtcgaggaacggtttgctcatgtcgaagacagaaaagggcatgaccgccgttacgccatcaatgcttcaaagctgaaaaatgagctgggatggcggcaggacgtcacatttgaagaaggaatgagaagaaccattcgctggtatacagacagccaagactaatcggaaagaaggggatccgattgacgaaggtattagtaaccggagcggccggtcagctggggcgggagttatgccgccagctgaagcgggaagggtatgaagtgatcgccttgacaaaagcgatgatgaacatatccgaccagcgttcggtgcggcactcgttcagccattacaagccggatatcgtcgtcaatacggcggcatacacctccgttgacaaatgtgaaacggagctcgacaaagcgtatttaataaacggaatcggcgcttattatgccgcgcttgaggctgaaaacaccggcgcgaaattcattcacatcagcaccgattacgtcttcagcggcaaaggaacacggccataccagaccgatgatcccgcagatccgggcacgatttacggaaaaagcaaaaaactcggcgaagaactgatccggttaacgggaaaaaaccacaccattatcagaacgtcgtgggtgtacggcagcggcgggcacaactttgtcaatacgatgctgaaacttgcggatacacatgatcaggttcgtgtcgttaacgatcaagtcggagcgccgacgtacacaaaggatttagccgaaacggtgatcggtctgtttgacaggccgccgggcttgtaccacgccgcaaacagcggagtgtgcagctggtatgaatttgccaaggctatttttgaagaaagcggcagaaccgccgccgtgctgcccgtcacgacggaggaatacggaaatgagacgccgcgccccgcttactcggtgttgagtcttgagtcgattgaacggcaggggctcggcatgaggcattggcgggaagcgctaaaggattatttacaaagggagggacagtgcaagtgatcgaaggcgtaaaaattaaaaagctgatcaaacacagcgatgaccggggttttttctcagaactcgtccgtgacgatgaacatctcttagagcgtttcgggcaggcttcctggtccaaaagctatcccggcgtcattaaagcgtttcactatcatgagaaacaggatgacctgtggtttttcccgacgggccacgcccaggtcgtgctgcatgaccttcgcgaagagtcggcaaccaagggagaaacggatgtctactacatgggagaagacaatccgatgctccttctcattcccaaaggcgtcgcacacgggtacagagtgctgggcgaaaccccgctgaccattatttatttcacgacaatgtcctacaatccggatcagcctgacgaaaaaagaatcccgtggaatgatgagagcatcggatttgactggcagacggctcatcggtagcgcacaagacgaagacagcggatgtcttcgttttttgtgctggttcatctcgtgaaaaataaatgattgaatattccaaaaaataatttacttccatggataaaggtggtagattattctcaggaaaagagaaacccaattcgcgaatggaatcatcagacacgcttttccggcagaggacgctctgaatcctatatgatctggaggaattcatgatgttaaaaagaaaatcattttctgcctttctcatcagtgctgcggtattttcagctgtgttcttgccatcttttcatgcgaacgcccaatctgccgttattgaagcgaaaaccgtcaatagtacgaaagaatacgcgacgtctgatattgaagtcacatacaagccgaatgcgctgcttgccgtcggcgccgttgaatttcaatttcctgacgggttcaacgccactgtgagggactctgtaaacggaagaacactgaaagaaacgcaaattctcaactacggaaaaacggtcagacttccgcttacccttgacttattgggcgcgtctgaatacaatctcgtcctggtgcgtaaaaaccttccgcgcgcgggcacgtatacaattaaaggcgattacgtaaacggtttgggggccggcagtctctacgccgaaacaaagctggttattgacccgcgttaatccgggatgaaagaggctgacaacagcctctttttttatgcgcaaaatcctggcatgaatcttgcatataaaaaggggtgtaacgacaatgtgaaagggattgatgggttttggtgtaaaagcgcttacatttcgttctgccggtaattgaagcttacacgtaaaatacgatgaggtgataaaacatgtcagccaacccgctttctaaaagcactcagaaagatgaagaaaaagaagttcttaatttgttcttgtccacacaatcgatcataaaagaagccctgcgcaaactgggctatcctgacaatatgtatgaactgatgaaagagccgatgcggcttttgaccgtacgcatccccgtcaaaatggacaatggctcagtacaggttttcacgggctaccgctcacagcataatgacgcagtcggcccgacaaaagggggcgtgcggtttcacccggaagtcagtgaagaagaggttaaggcgctttccatctggatgactttaaaatgcggcatcacaaatcttccttacgggggcggaaaaggcggcatcatctgtgatccgcggacgatgtcattcggagagctggaacggctgagccgcggatatgtgcgcgcgatcagccagatcgtcggcccgacaaaggatattccggctcccgacgtatataccaactcgcagattatggcatggatgatggacgaatacagccgcctgagagaatttgattcaccgggattcattacgggcaaaccgattgttctcggcggttcacaggggcgggagacggcgaccgcgcaaggtgtcacgatttgtattgaggaagccgttaagaaaaaagggattccgttggaaaatgcgcggatcatcattcaggggttcggaaacgcggggagctttctcgctaaatttatgcatgacgccggcgccaaggtgatcggcatctcagacgcccacggggctttgtatgaccctgacggccttgacattgattacctgctggataagcgggacagcttcggcacggtgacgaatctcttctctgatgtcataacgaaccgggagctgctggaaaaggactgtgatattctcgtgcctgccgcaatctccaatcagataacggctgaaaacgcccatcacattaaagcctcaatcattgtggaggcggcgaacggcccgacaacgatagacgccacgaaaatcctgaatgaaagaggcgtgcttctcgtgccggacattttggcaagtgccggcggcgtgacggtgtcttattttgaatgggtgcaaaataatcaaggcttttactggtctgaggaagaagtcgccggaaaactgcgcagcgtcatggtgaattcgtttgaatccatttatcagacagcgcatacccacaaagtcgatatgcgtttggccgcctatatgacgggcatcagaaagtcggctgaagcggcccggttccgcggctgggtataagtgttatccgcaaagagattttgcatcagttatatagcggatcgcaaaatttctttgcgttttcagattgcagctgacaggttcggacaagcttcgtccgctttcggcaaagattttcctatttttatcacaaattgctatgctggtatgcttcttgcatcttcattaagcgtgagcacacattacaaaatacggggaggaattctaatgacagtttcatacgcacacgaaccatttacaaattttcaggaagagacaaataaacaatcgtttcaggaagcgctggcttatgtgaattcacagctcggcaagcattatccgcttatcatcaacggtgaagcgattgaaacggataaaaagatcatttccgtcaatccggcagataaaaaagaagtgatcggttctgtatcggcagccggaaaagaacttgcggaaaaggccatgcaggctgcgctgcaggcatttcaaacatggaaaaaagtacggccggaacaccgcgcgaatgtgctgtttaaggcggcggcgatcatccgcagaagaaagcacgaattctccgcgtacctggtgaaagaagcggggaaaccgtggaaggaagcggatgcggatacggcggaagcgatcgactttttagagtattacgcccgtcagatgctgaagctgaaagacggttctcctgtaaagagccgtgacggagaatataatcagtatcactatgagccgcttggggtgggaattgtcatttctccattcaacttcccgcttgcgattatggccggaacggcggcagccgccatcgtaacaggcaacacgatactgctgaaaccggcggatgcggcgcctgtcgtggcggcgaaattcgtagaagtgatgaaagaagcgggcctgccggacggcgtgctccaattcataccgggcgacggaggagaaatcggcgactatctcgttgagcatccgaagacgagatttgtgtcgtttacaggctcccgcgcggtcggatgccgcatctatgaacgcgccgcaaaagtacagccgggccaaaagtggctgaaacgggtcattgccgaaatgggagggaaagatacggtgcttgtagacagagatgctgatcttgatcttgccgcttcctcaatcgtgtattccgccttcggattctcaggccaaaaatgttcagccggttcgcgcgcggtcattcatcaggacgtctatgatgaagttgttgaaaaagccgtcgctttaacaaaatcactcaccgtcggaagtccggaagattttgatacatacatggggccagtcatccacgaagcatcttataataaagtcatgagttatatcgaaatcggcaaaacagaaggaaaactcctgacgggaggcgaaggtgatgattcaaaaggatactttattcagccgaccatttttgcggatgttgatgaaaacgcccgcctgatgcaggaggaaattttcgggccggtcgttgcgatctcaaaagcccgtgatttcgaccatatgcttgagattgccaataataccgattacggactgacgggcgctctgttatcgaaaacccgcgcgcacattgaacgcgcccgcgaagattttcacgtgggaaatctatacttcaaccgcggctgtacgggagcgattgtcggataccagccgttcggcggcttcaatatgtcaggaaccgattcaaaagccggaggacctgactatctgattcttcatatgcaggcaaaaacaacgtctgaagcctattaatctttcggaaatagcgcgatgaaaaagagagtcgcgctattttctctatatgagggtaagggggatggaacatgtatcagcagctcagcaaaatgcttccggaggagaaaatagaagccattacgaaatcactggtggcgttaaacagcatcaacggcacattgggagaaggaaaaaaagccgactatatcaaagatatgatcaagagctttccctactttcaggagaatccgtcacatgtgtgggagcaggcgattcctgaggacccttacggccgcaaaaatattttcgcatttattgagggaaacggcgaaagcctgaatacggtcatttatcacgctcatcttgatacggtcggcatcgaggatttcggccctttaaaagatatcgcttttgattccgaccgtctcgcggaatatttctcaaactatgaatttgatcgggatgtgcagcgggacgcccgctcaggcgagtggatgttcggaaggggttcggttgatatgcagagcggtattgccgttcatctcgccaatctgcttcacttttctgaacggcgcgatcagctgccgggccatattctgttcatggcaaacccggatgaagaaagccagcattccggcattttaaccagcatttctgaattaaaacggctgaaacaagaaaagcagcttcgttatttagcagcgattaataacgattttatcacgccgctgtatgagggtgacacgacaaggtacatatacacgggcgcggcagggaagcttttgccttgctttgcgatttacgggcgggaggtgcatgtcggagatacgctgtccggcatcgatccgaatttgatcgcgtcagaaatcaccagaagaattcacaacaatattcatatggcggaaaacattgaaggggagcttgtgcttccgccgacctgcctctaccagcgtgacaataaggaagcgtataacgtgcagaccgccgtcagcagctatgtctattttaattattttatttacgagaaaaccgccaaagaagtcatggatcagctgaccgccgtggctgacgaagcctgcaaagagacagaacaaaaattatctgattattacgacgaatactgtgagagaacgagcctgccgaaaaaagagatgtcatggaacgttcaagtgtacagtctggaagattacctgaaaaggctgagaagccgcgggatagaccctgcacagtgtatcgggcaggcatttaaaacatatgaacatcttgaactgcggatgagatgttttaaagccgtcgaagaactgcaaaaactcgatcctgagcagggagccaaggtcattattttctatgcgccgccttaccttccgcacaattatctgaaggaagaaagcacacgggaccggcttttgcagcatgtcattcaagaagcggtcgataaaacagcggcatcaaccggagaaacattcgtctttaaaaagtttttcccttatttggcggacggaagctttttatcgctgcatgaaacagatgaggaggtctccgcctttaccgataattttccgggctgggatgtcatcgggacgattccttttaatgaaatcagggaattgaatattccgtcggtcaatataggggtatacggaaaggacggccataaatggacggaacgcgtgtacaaaccgtacacattccatgtgctgccggaactcattcagcagacgacaatgcaccttttgcacagctgccgattagacatacgcacaaatggctgacataacggaataaggggatgtatatgcagggagataccaatcaaaatgaattgcagcgcacgatgaagggccggcatttgtttatgatcgccctcggcggcgtgatcgggacggggctttttctgggctccggttttacgatcagtgaagcgggaccgatcggcgcgatattggcttatgtgatcggcggatttttaatgtacctggtgatgctttgtttgggggagctcgcggttgccatgccggtcgcaggatcatttcaggcgtatgccgcaaagtttctcgggccgtcgacgggatttacgatcggatggatgtacgcattcagctgggccaatacagtggggcttgagctgacgtcggcggggattttaatgcagcgatggtttccggccgttccgatttgggtgtggtgcctggtatttggcgtcgtcattttttccattaacgcgctgtctgcgcggagttttgcggaaatggaattttggttttccagcattaaggtcatggccattgtattgtttattattctcggctgcgctgcggtattcggctttgtcggttttaacggcgggcagacggctccgtatctgtcaaactttacgacggacaaagggctttttccgaacggcgcccaagccgtgctgtttacccttgttatggtgaatttttcattccagggtaccgaactggtcggaatcgcctcgggagaaagcgaaaatccggaaaagacgcttccccgctcgatccgaaacgtcatatggcggacgctttttttcttcgtgctggcgatgtttgttctcgtgtccattttgccgtatcaaacggcaggcgtcatcgaaagcccgtttgtggctgtgctggataaaatcggcgttccttatgcggctgatatcatgaactttgtcattctgaccgccatgctgtcggtggcgaattccgggctgtacgcttcgtccagaatgatgtggtccctgtcaaaaactaagatgggccccgcttccttaacgaaactgacgaaaaaaggcgtgcctctgaaagctcttttcatcaccatcgccatctccggtttatccctgctgacaagtgtagtcgcggctgaaacggtgtatgtgtggctcatttccatctccggtatgattaccgtcgtcgcgtggatgtcaatctgcgcttcacaattcgttttccggagacgctttctcgctgaaggaggaaatctgaaggacctggcatttaaaacgcctctttatccgatcgtgccgattctcggattttcggtttacggtcttatcttaatcagtctcatctttatccccgaccagcgtatcggtctgtactgcggtgtcccgctgatgatcatctgttacgcgtattatcacttcggtatcaaaaaacgcctgaagcgtgagccggcttcttcggaaaaaggcgctgccggataagaaaaaaagcccttcgcttaaagcggcgggctttactttgtgtttcgtttggccgacagaacataggatagaacggcacagaactgaaaaccgaaaatgctgacggccatcggccaggcattttcttctccggcaataccgacaaggggagcggcagccgcaccgccgataaagggcaggagtccgagaagagccgcagcgcttcccgcgcctttctcctgtttctgcatagccaaagaaaatcccgtcgtcgtgacgatcccgacagaagaaacaatgatgaataaagaaatgcagactgccgccaggcctaaaccaaacgcaagtgataaaagcaaagcgatgctcccgatgacggcaatcatcagaccggagacaaacagcttccgttcatcatgtgttttggccatccgtccggtgatttgggtggcgcatatgattcccgcaccgtttacggcgaacagcaggctgaacatttgggccgatacgccgtagatgttttgcagtataaacggcgacccggcaatatatgcgaacatgccggtcatcacaaatgcctggctgagcgcaaatcccataaacatccggtcgccaagcaggccgcgaaacgtcatcagcgtctcccggagtccgccgcttgtccgcttttccggcgggagtgattcaggcaacaccgtaagcacggcggcagaaatgatacagccgattaccgccagcacgataaatacgattttccagccggcgaactgaaggataaatccccctgtaatcggcgctaaaatcggcgccgccccattgacgagcatcagtaatgagaaaaaagccgtcaattcttttccggaatacatatcgcgtgcggaagcccgtgcgatgacgattccggccgccccggtgaaaccttgaataaacctcatgacaattaaaaacgaaacagaagggctgaaggcgcataataaagaagacagcgtataaagcagcaatgacagaatcagcggcttccggcgcccgatcatatcactgagcggcccgacaacgatctgcccgacagccagacccaaaagacaaaacgtcaggctcagctgcgcaagtgacgctgtcgtatgaagatcggccgccacttcaggcaaagcgggcagatacatatcgagcgaaagcggcccgaatgaagcgagcgtcccgagaatcagtaccatgccgaggcctgcgcgggcggcctttgaatcagcgttattcatttcatgacccccaccttaacaaatgattctatcactatagcataaccagacggcgtattttatatcatttattgaatataaactaaatattttatttaaaaatctgaatgtaaataaaaaatcagaattagttttcatgtgaaatgtaaaatgaaatataaggatgctaaactataaaacaacaaaagatagaaaagttttacggaagaggtgttcaaagagcatgaacagcaaacaaaccgatcacatcgaaacgaaacgccgatttccggtctgtctcgcgcttgctttgacattaggcgtatttgccgcgggttctgaagagctggtgatttctccgctgcttccggatttagcgcgggctttcagctcggatgtcagtgtgctggcgctttccatcagtatttacggagtgatgatttttatcggggcgccgcttctcgttccgctgggagataaatattcccgggaactcagtctgctggcgggactgcttatatttacggccggcacggtgatctgcgcgctggcgcacaatctctttttcttctttctgggcagggcgctttccgggcttgcggcgggtgcgtttgtgccgacagcatatgcggtggtcggcgaccgtgtgccttatgcgtaccgcggcaaggtgatgggtctgatcgtgtcaagctggtcgctcgctttgattttcggcgttccgatcggctcttttatcggcggcgttttgaattggcggtggacgttttggattttcgccctcatgtctgtcctcgttgcttcgctcattttcattgaggcgcgccgcagcacggcggatgggaataaaacagaagaggaaaacggacggcaggcaggcactttccgggatgcgctgaaggtgccccgtgtccctgtatatctcacgatcactttttgcaacatgatcggtttttacggcatgtattcctttctcggcacatatcttcaccgcgtgctgccgggtgggaatacagcttcagggctgctgatcatggtgtacggaatcggtttttccatgagcgtgttcaccggaaaaatcgcagataaggcggggaaaatgcgctctttgatcgcggcattggccgtgatcagcatatggctttcctgtctcgcctatgcgccgtcatcaatgccgtttttggtcatcgggttattcgtctggggattgatgcaaagcctgacggtgaccttgctcagcactattttaagtgattgctcacagagccgccggggcaaaatcatggcattttacagtctggcgtccaatttggccgtcaccttgggttctgctgtcatgggtccggtctatgtcggatatggatatgcagctgtcggatttatctgtgcggccgtcaccctcatcggctttgtcctcagcgttttcgcatacagaaggtatggaaaatatgagcataagaccgaccaatcattgtatcggtaaaataaagtttctataattttgtaaatgtaaatttttaacaccttatattataaggtgttttctaatatataggaataattatcaatattttcaaataatattgacagcttgaacgtctatggataatatttacttaaaatttaacagattggttggtgctcatgattatattggataatagcattcaaacaaaaagcaaggcttattcaatatctaaactgattacgatcaacacgctcggtcctgaagggacaagcagtgagtacgcagcaaaaaacttcatcaccaatttcacccttctccaaggggtgaacagcaaattatcattgcatgatacatttgaatcgtgcattgaaaaaacgcttcaaagtccgctggaatacacaattgtgcctcacgcgtatgacggcattaagcacttctacatgagaccggatctgcagcttctgcaaattttcaggtgcgacaccccgatgtacggcctggctgtccggcccggttttgaatatacggatgacatgcttgataagactgtcatcgtatcccacccgtctcctatcaatttgattaagtattttacccgtaaagatgtcacgtttgatctggtgaactcaacgagcgcagccgcgaaaagagtgaaggacggtttgtccgacatcgcgctgacaaatgagctggccagacaaaagtacggccttcactttgtcaaaacatttaaaagcattcccatgagctggtcattattcggaaaaggagagattcatgatgaaaactgaacaagatttgcaggaactttatttcccgacgcctaaattaatagaatgggataacggagtaagacaatattcgtccgtcagaggcgatacggaagttctgctttcttacgttccgccgcatacaaacgtggaaccgcatcagcataaggaagtccaaatcggccttgtcgtttccggcgagctgtccatgactgtcggagatgtcacaagaaagatgacagcgctggaatcagcctatatcgcgcctcctaacgtgcctcacggcgcaagaaatgagacggatctagaagtgatcgccattgatattaaacgcctgaaagccggtgaaacctatacaagccctgaggattattttttgaatatttttaaaacgagagacttattgcctgggatggaagtcacgttcttcgtggaagactgggtggaaatcatgcttgccaacattccgggcaacggaggagaaatgccgttccataaacaccgcaatgaacagatcggcatctgcatcggcggtggctatgatatgaccattgaaggctgcaaagtggatatgacattcggtacagcttatttctgcgatccgagagaagatcacggcgccatcaacagatttgaaaaagattcaaaatcagtcaatatctttttccctccgcgctataacagagcaaaagcgaaaaaattagaggcgaaagagtcatgaacctgacggataaaacggtcctcatcacagggggcgcatcaggcatcggttatgccgcggttcaggcgtttctgaatcaagaggcgaatgtggtcgtcgcggatattgatgaggcgcagggagaagcgatgatccggaaagaaaacaatgacaggctgcattttgtgcagacggatattacagatgaaccggcatgtcaaaacgccatccggtcagcggttgacaagttcggcggattggatgtgttaatcaataacgccggcatcgaaattgtcgccccgattcatgagatggagctgagcgattgggacaaagtgctcaacgtcaatctgacgggcatgtttcttatgagcaagcacgcgctcaagtatatgctcaaaagcggcaagggcaatatcattaacacgtgctccgtcggaggagtcgtcgcatggcccgacattcccgcatataacgcctctaaaggcggcgtactgcagctgacgcgttcgatggccgtcgattacgccaaacacaacatccgcgtcaattgcgtgtgcccgggaatcattgacacacctttgaatgaaaagtcgttccttgaaaacaacgaaggcacgcttgaagaaatcaaaaaagaaaaagcgaaagtcaatccgctgctgagactcggcaagcctgaagaaatagcgaacgtcatgctgtttctcgcttcggatttatcaagctatatgaccggaagcgcgatcaccgcagacggtggatacaccgcacaatagagaaggagtgtttacatatggagagaaaaacagtattggttatcgctgaccttgggggatgcccgccgcatatgttttacaaaagcgcagccgaaaaatacaacctcgtcagctttattccgagaccttttgcaattacagcctctcatgcggcattaattgaaaaatactcgattgcggtcattaaagataaagactattttaagagtctggctgattttgagcatcccgattcgatttactgggctcatgaagatcatgacaaacctgaggaagaagtcgtcgaagaaatcgtcaaggtggctgacatgttcgcggttgacgccattacgaccaacaatgaactgtttatcgctccgatggcaaaagcgtgtgaacgtctcggcctgcggggagcgggcgtacaggccgctgaaaatgccagagataaaaacaaaatgagagccgccttcaaccgggccggcgtcaagtctatcaaaaataaacgggtgacgacgctggaagatttccgcgccgcgcttcaggaaatcggaacgccgcttattctgaagcctacatatctggcgagctccatcggcgtgacgctcatcaaagagagggaaacggcagaagcagaatttaacaaagtcaatgaatacctgaagtcgattaacgtaccgaaagcggtcacgtttgaagcgccttttatcgcggaagaatttttgcagggcgagtatgacgactggtacgaaacaagcggttattccgactatatcagcatagaaggcatcatggccgacggggaatacttccctgtggcgattcatgataaaacaccgcaaatcggattcacggagacatcgcatattacgccgtccatcctggatgatgacgcaaagcggaaaattgtcgaagctgccaaaaaggcgaatgaaggactcggcctcgaaaactgcgcgacacatacagaaattaaattaatgaaaaaccgggaagccggactgattgaatcagcggcgcgatttgcgggctggaacatgattccgaatattaaaaaggtcttcggcgtcgacatggcgcagctgttattggatgttctctgtttcggaaaagaagccgatctgccgaaaggattattggagcaggagccatgttatgtcgccgactgccacttgtatcctcagcatttcaaagagaacggccagctgcctgagacagctgtcgatttcgtcattgaaagcattgacattcccgacggcgtcttaaagggagacaccgaactcgtttctttctcggctgccgaggcgggtacatccgtggatctgcggctgttcgaagcgttcaacagcattgcggcgtttgagctgaaaggaagcaattcgggtgacgtggccgaatcaatcaaacaaattcagcagcaggcgaagctgactgcaaagtatgcgttaccggtatgaaacagctgaaaccgaactcgaagtatttgcttttcgggcaggcgctttcgtttatgggagactattgcgttctcccggccctgctcattttgtctacatactatcatgactactgggtgacgtccggcgttatcgcggtccgcagcattccgatggtgtttcagccgtttttaggcgtgctcgtggacaggctcgacagggtgaaaatcatgctgtggacggatgtgatcagaggtgtcatctttttggggctgacatttctcccgaaaggcgaatatccgctgctttttctggcgctgctgtttgtctcgtacggaagcggcgtgttttttaacccggcacgtctcgcggtcatgtcgtctttagaagcggatattaaaaatatcaacactttgtttgcaaaagccacgacgatttcgattattgtcggcgctgcagccggcggactttttctgttaggcggttctgtggagcttgccgtcgcgtttaacggggtgacctatcttgtctccgcgtttttcatcagccgcattaagcttcaatacgtgccgattcagtcagaaaacgtaagagaagcttttcagtcgtttaaagaaggcctgaaggaaatcaaaacaaatgcttttgtgttaaacgccatgttcacgatgattacgatggcgcttttgtggggtgtcgtctacagctatttcccgattgtcagccgctttttaggcgacggggaaatcggcaatttcatcctgacgttctgtatcggcttcggcggctttatcggcgccgctcttgtcagcaaatggggctttaacaacaataaagggctgatgtattttacagtgttatcgatcgtctcgcttgcgctgtttttgtttaccccgattttcgccgtgtcagtcattgccgccattcttttctttatcgcaatggaatacggtgaagtgctggcaaaggtcaaagttcaggagaacgctgcgaaccagattcagggccggatcttttcggtggcggaggcgtccatcggattgtgcatcgccgccggttccatgctgatcaacattgtagacgcggcagtcatcatggcgtttatcgtccttttggtcagcgggctgtttctgcatacaaaactggtcaataaatccttttcagaacggaataacgaatcagagcaaatccatttataaggagccttccagatggaaatcataccgtccgatgtcatcaagacacttccgaaacaggaattttcgctcgtttttcaaaaggtaaaagagatggagaaaacgggagcccagattattaatctcggccaggggaatcccgatctccccactccgccgcatatcgttgaagcattgcgggaagctgcgctgaatccttcatatcacggatacggccctttcagaggctatccgtttctgaaagaagccatcgcggaattttatgagagagagtacggggtatcggtcaatccggagacagaagtcgcgctgttcggcggagggaaagcaggtttgtacgttttgacgcaatgcctgctgaaccccggcgatatcgccttagtcccgaaccccggctaccctgagtatttatcgggaatcacaatggccagagcggagctgcatgagatgccgcttcatccggaaaacggctatctgccggattttgagcggattgatcccgccgtcctgaaaaaagccaagctgatgtttttgaattacccgaataacccgacgggcgcgactgcggatcaggcgttttatgaaaaagcggctgcgtttgcaaaaaaatatgacatccatcttattcacgattttgcatacggcgcgttcgaatttgatcagaacccggccagctttcttcaggcgaaagaagcgaaaacggtcggcgcggagctttattcattttcgaaaaccttcaatatggcaggctggagaatggcatttgccgtggggaatgagaaaatcattcaggcggtcaatgagtttcaggatcacgtcttcgtcggcatgttcggcggccttcagcaggcggcagcggcggcgctgtcaggaaatcctgagcatacggagcgtctgaagcgcacatataaagaacggattgattttttcacggcgttatgtgaaaaggaattaggctggagcattgaaaaaccgaaagggactttttatgtctgggctgaaattccgaatgaattcgagtcttcacaccagttttcggactatctgctggagcatgcccatgttgtcgtgacgcccggcgagattttcggcagcggcggaaagcgttatgtcagaatatcaatggtggcaaaacagggcgatttaagggaattcgtgctgcggattcaaaagctaggtttgtcctttccttcattacaagaaacatcccgctgagagcgggatgtttttattatatgcttttcatgctgccgccgtcggctgacacttgctgtccggtaatataggaggcttcttcagaggcaagaaaggcagccagcgccgcggtttcttccgcagttccgacacgcttcatcgggacgcctgaggcaatccgttcctccgcttccgctttagaaatgccgttttgcttcatgacattctttacgaattggtgataacggtctgtggcgataaatccgggattcagacagttgacagtaatgtgaaaaggcgcaagctgaatggcgatgtttttgctggcattaattaaagcggcgttcatcatgctgttggtaaacatattggcgccgggttctttccataggtttccgacgatattaatgattctgccgaattcgtgctgtttcatgatcgctgcggccgttttcatagagtcgatataggcgatcgttttattcgtaaaggtatttgtcatatcctctatatcgcagctttcaaaggtatccggcgagccgcccggaatgttgttgatcaatacatcaagccgtccgcattgtgatctgatctcttcaaaaatgccggctctcgccttctggtccgacatatcgccggccagaacggtgacgcccgcatccggatgtttggcgaggatctcttcttttaccgattcgatattttcgggaactcgtgaattaatgacggtatgaaagccattgtccgccagtttcagagcgatcgctttgccgatcccctggctggctcccataataaatgcggttcgttttgacaactgtctgcacccctttaccaaaatggaatctcctttacatcgtaaaaaaaaatgataaaaatagcaaattttatttaaattctgacaaagaaaaaacccgccggacaggcgggtgggtgttacacgtgcaaaaacttcggaagcgtgtcaagagacaagcggtttccgacaaaaaatgaaccgaattctccgtagcgcgcgctgacttcatcaaagcgcatttcataaacaagttttttgaactgaagcacatcatcgctgaagagcgtgacgccccattcgtaatcgtcaaaaccgacagaccccgtgataatctgtttgactttgccggcatagctccgtccgatcaagccgtggcttctcatcaggtttctgcgttcatccatagaaagcatgtaccagttgtcgttgccgcttcttcttttatccatcggatagaagcagacgtatttcgcttccggcagctcaggatacaggcgtgcgcggacatgcgggttttcatacggatcgccttctccgcttgcgaggtagttgctcagctcaaccacggacacgtaagagtaagccgggatcgtaaattcagcaagctttgatttgttaaattcaagctcgatttcgttcagctcttccattgtcgggcgaagaatcatcagcatgaaatcagctttctgtccgacgatgctgtagatggtttgcgagcctttgccttctttttgggcgacgccccatttttcaagcagtcccgtaaattcgtgaataatcgacaggcgctcatcgctggataacatcttccatgacgtccagtccattgtgcggaaatcgtgaagcgcgtaccagccgtcaagtgtttgggcggcttcgttcgttttttgctgctcactcatgtatcttcactcctatatcttttcattacattgatgccttcactatatcacagtttaaccgtttcggctgtggagaaaccttgaataatccgaagccttgtgtcagaaactaagccgtgaaacaaaccgtcaattaaattagttagaaaaataagatttctttttgaaagcgctataatagaagttggttatttgaatttagctggaagaagagtatgctgtaaaagtaagcgttttttgtcaacatagaggagggaatatcgtggcagatttatttacaaaagtacaagaaaaagtcgcaggaaaagatgtgaaaatcgtatttcctgaagggttggacgaacgtatcctggttgcggtcaacaacttggcgggcaacaaggtattaaagccgatcgtagtcggcaataaagaagacattcaagcaaaagcgaaagaattaaatcttacgcttgacggcgtggacatttttgacccgcatacatatgaaggcatggaagaactcgttcaggctttcgtagaacgccgcaaaggcaaagcgacggaagaacaggcccgcaaagctttgctggacgaaaactatttcggcacgatgcttgtgtacaaaggtctcgcggacggacttgtcagcggagccgcacattctacagccgatacggtgcgccctgcactgcaaatcatcaaaacaaaagaaggcgtgaaaaaaacatcaggcgtcttcatcatggcccgcggtgacgagcagtatgtgttcgctgattgcgcgatcaacattgctcctgacagccaggaccttgccgaaatcgccattgaaagcgccaatacggctcaaatgtttgacattgacccgcgcgttgccatgctcagcttctctacaaaaggatcggcgaaatcagacgagacggacaaagtggctgaagccgtgaaaattgcgaaggaaaaagcgcctgagcttacgcttgacggcgaattccaattcgacgctgcatttgtgccgtctgtcgcggagaaaaaagcgccggactccgacattaaaggagacgcgaatgtatttgtattcccaagccttgaagcaggaaacatcggctacaaaatcgctcagcgcttaggcggctttgaagcggtcggaccgattctgcaaggattgaatatgcctgtaaacgatctttccagaggatgtaatgcggaagacgtctacaatcttgcgttaattacggctgctcaagcgctgtaatccgcaaaagccggtctttacgaggaccggctttttttatagaaagaatgtcactgcggcccagccgaacagggacaaacagagagaaccgatcaagcctgctgcgagcgcccgccagccgctatgacgaaacgccgatatatggactttcaaaccgagacccgccatcgccatgccgattaaaacataagacacttgaacaagaaacgcggaaaacgaagctgaaataacgcctgatgtatggatggcgctcattccgagaaatccgaagataaaccaagggatggggagcgaagcggcagaagccgtctttgactttccgctgcggcgcgcccgcattccgagcatgaatgcggccgggacgagcagcgcgacccgggtcagtttgacgatcaccgccatctcgacggctgcttttcctccggcgctgccggccgccgccgcatgcgccacttcgtgaagcgttgccccgcaaaaggccccgtaagccgcaggagaaaaccccaatccatgataagcaagagaatatacaacagtaaaaacggttcctaataacgaaacggcggccgcgctgatggcggctgcattttcatttgatctgatctgcggcgcgatcgcggcaatggcagccgccccgcagatcgctgtgccgcaggctgtcagcgtgctgagtgtctgatctatacggaacagccgggacagtccgtatacaacggcacccgcaaacatcatacagcagacggcaattgcaaatacgtgccagcccgcatgatagatatccgccagattcagtctcatgccaagcaggatgatgcctgctttcagcaagtatttgcttgagaacgcgatccccggctctaatgccgcccgctgtccgaatacggcgcgccagagcatgccgatcagcatggcaaggacaagcattccgagcatatgcaaaaacggcaggcggctgacatagaaagccgcaaacgcaattcctgcggtaactgaaataccctttatcatcttcatctcagtcacttcccattatcttgataactccactttactgcggtcttaatcattagtaaaatatatttatatgatctaaacgattaggaaaaataatgattaggggcgatgctttttgtattacggggaactgaaaacattcattgccgtcgtggaagaaaaaaactttacaaaggcggcgcagaagctgatgatttctcagccaagcgtcagccttcacattaaaaacctggagaaagaatttcaaaccgctttgctgaaccgctctccgaagcactttacgacgacgccgacgggggacattctctatcagcgcgccaagcagatggtctttttgtacgaacaggcgaaatctgaaatttacgcccaccatcattatgtcaaagggaagctcaaaatcgccgcgagctttaccatcggcgaatatattctgccgccgcttctcgcaaagcttcatgacgagtatcccgagctgaacctggacgtcatgatcggaaacacggaggaggtcagcgaagcggttcggatgcttcaagccgatatcggattaattgaagggcatacggggaaaaacgagctcgacattcagccgtttatggaggatgaattgtgcattgccgcaccgaacggacacccgctcgccggcagaaaaaacatcccggctgccgaattgcaaaatcaagcgtgggtgacaagggagaagggttcgggaacgagggaatatttagaccacgtccttcaatcaaacggactgcggccgaaatccatgatgacgatcagcagcaaccagggtgtcaaggaagccgtgatcagcggaatgggtctttccgttctgtcaaaaagcgtgctgcaaaaggatctgcttcacggcagcatttccgtgcttgagataaaaggattctccttaaaacggaaactgtctatcatccaatcttccattatggagaacacaaaaaacaaagaaatcttcatcgctcttttgaaaagccaatttcaatcatctcaagcggagtgatataataaacgcatggaaagcttatgacgaaagggatttaatatagatgggaaagcaaccgattgatttactgatgcagccgagctggagaatcattgaccaatccagccttggcccttattttgatgcgaagcagtcattcgcaatggatgatacgctgtgcgcctccgtaggcaaaggggaatcgcctgcgacggcacgcacttgggtgcaccaccggacgatcgtgctcggcattcaggacacacgcctgccgtttttagaggacggcgtgaaattgctggagggcgaaggctaccgtgtcattgtccgcaattccgggggcctcgcggtcgttctcgatgaaggcgtattgaatatttctcttatttttgaagatgagaaaaaaggcatcgacattgacagaggctacgaggcgatgacagagctggtgcggcggatgctgtgtccgtacaatgccgaaattgaagcatatgaaattaaaggatcgtactgtccgggcagctatgatctcagcatcggcggccgaaaattcgcgggaatctcacaaagacgcctgcggggcggaaccgcggttcagatttacctctgtgccgataaaagcggaagcgaacgcgccgatctgatcagacgtttctatcaagccgctttaaaagacaaaagcaacgatacaaaaggcgtatatcccgatatccggcccgaaacgatggcttcattaagcgaattgctgcaaacggacattaccgtgcaggacttaatgctggcgcttttgactgaactgaaggaactcagcggacgcctgtatgcagccggattatcgccggaagaggaaatggtatttgaaaaaaatctgatccgaatgctggaacggaatgagaaggtgttcggcacgcaggaaagcttggactgagtccgggcttttttatttttggtaattatatactattcagttatagtgaaaaagaatcgttatatcaaaactagtttacattatataccttatttgattaatatatttatgtaggttccaaataattctataaactgaaggagatggagatatgaactttaaaaaaataaaagaagaaaaaagaatcacgatccctacacatttgttagccggagatgcggaacaatcaggcaattctttcgcttggagcggctgggtgcttgtagtgccgagccaagaagacaatcaaaacccgaatttgaatttctctgatttagccgctcaaaagtaagataatgactgtttggagcctacgcattcgagacgaggcggtgagagtgtgacacaagagtatataagagaaattaagcggggagcactgtcatggattgttgaaaatatccattattttgatatgaaacataaagtagcgaatgatttcagatggcgccttaaaacatttatagaactcatttttcttaccaattacctgatcagaaatcaggcagatgataaggaagttgctgttttaacggagtttattacagaaaggctccgtaatgatcagcttgaagaatttattcattttgatccggacggtctcgccggattggctattgcgggtgaatttcttaccttgactgatcatccgtcacaagcttcagtgatatgggagctggaaaaattcacggcagcgcgttttgattgcagccttgctaaaattccctttcgaaaaatggatctgaagtacagtctgcaaagagcaggcgtaacctcggaaataacggatttttctgacttatatcactacacagcagctggtcaggatatcccaaatacatatatgacggatcatgatgcatacagtatcactcatacgattttttatataacagacatgggatgttcttctcttacggataaagagtatcatctgtcgtccttaaaagaaaaggtcctgaaatttctcgggatctatatctgtcttgagaatttagatattaccagtgaattattgatgtgcagctcttttttacatatcgacatggataaggacaaccataaaccgctctatgaagcagcctggaataaaatctatcggggccaaatgaaagaggggaatgtcccgagcatcacctatcaacataaacccggtttgaaaggtgaacagcgaagagaagatgtgtttaaacattgctatcatacaacacttgtcgccgcgggtgccgcgcatgcctgccttagagcagaaaggaacgattaacttgaacagattagctgaagagacggatcaatttttattatcttttgctgaacaatcgcttccggatcaaaagagcattcagctgtttgccggcttctgcaaatactacagaaagacgagccattcttccgctgtaaaagaacatactgaaaggattgcctccgctttcgttgataagtcatgctgggaagatctgtttcactgtaacacggccattgtcaatgagttgattcatatctatttaacggcaaaagcttataaaaagaagcagggaatggattcggatgatcaagtcatacgtcacggattgcaaaacggctatcttataaaaaaagaatggccttattttaaatacgccgaattcgccggtttgctgaacgagctgggaatgtcaactgaccatgaaaaagtgcgcttttacaagaattcgatatttcagcctttgctccatgacgcatggaaaagaacagctgaaaacgagctggagtttgtcgagtactgtcttcttcatttagatcagggagagcatctgcttcatcccggcttgaaggcgtccattcaaaaatggcttgtgttttgtctcggcagccgaaaaatgaaacagctgtgcaatatgttatttatccaatcgtgtatcgatccatttttttatggctgtcaagcggctcttcatcatataaataacgagaatccatccattcattgtgctccggctcttctgccggcgattgagattctgaatctggagtgtggaacatgcggatagtcaaggaacattttaatataaaaaaacagaagaatggctgctgggtttttggaagaacattcagctgcagccggaagaaatggaagcagatgatctcatgcacctgttttgcggtttagcggcatgtcatcactttgaaaaaagaaaggatacagaagaagtcattctattcttagaccgttattttggagaaaaaacgcacgaatgccatccggtcctgttcgcgtatgcgtatcatatataccgcaggatgaatgccgcaaaaagcatcttttttcataacggacttgaacaaatggtccgcggtttacaagaggaactgaaatcagagccttcctctatgatcctcatggtgttagcagcttattttggggcggtgaccccggaagaactgatcgttttcttagaaaccgcaatgaaacgtgaggccgatttgctcatggcaccgggcagcatccaggaagagcaggcagatgccctttatgccgtctcttatttgcaaatgaaaaaattgcagccttttctcacggaatggtacaaaacatcagactttgctttttcaggtttaatgttagccgagtgcagaaagtatcacattgacgccgttgcaaaatacacagccattatgaaatttctccgattcgatgaggcgctttttatacgggaagggcgggaatttctacgctttcagcagcgaagcagcggaagcttcggttatttaaatccattagcgatggaccaaggggcggtcagcggcaaattgctggaccgtcaatatttcctgccgtccgctcattatgccgccgcctctctgtctatgctgtaatgtctctcttttgaaagacggaaaaagaaatcaataaacaaataagaaagtagatcgctataaccgtcacggaataggggatgtttaacgttgaaatcgcatcacccgcacttttatttacataagcaacgaggtttaaatgcggaaagagtgtaaatttataccatgtaaattgggcaagcaaatcagttccgcccaatatactgccggcaaacagcagtaaaatggataagcaaagggagagcgcctggcttttgcacaatactgacaaagtgaacgcaatggtgacaatacttataattgatatgaaacgcaaaagcagaatgattccggatgctttgattgaactgatggtatacagactgtcatttaaatgagtatagacgagcggatatgaagcattggaaaaaccgaataacacgccgccgatcagcaaacagctcacacagtaaaataagtaaaccatgccggtaaacagaagagaggccagaaatttcgatgttaaaatccgccatcttcggttcgggcttgtagcgataaacttaatcgtcccaagggcaaactctttagaaacaaccccgctgacggttaaaatcgcagtcaagcttacgaaaatctcaagcccgtttgaagtaaccgtgccgaaaaacctccagccgttccattcataagggttgatgttatgctccaaataatagtctttattcttaacatcagcagaataataaacgcctgccgtttcagccggtttattaatttcttcctgttttttttcggcgagaagccgttctttccaattgttatccgaggaagcatctaactcatgattcataataaggccggccagcaaaacgatgagaaacaggaaaaaaagagataaaagtgtgcctttttttcgggttatttttatgaattcgttctgcgtcagatgaaatatgctcataccgcgtcctcctgatctgtaatcatcatgtatttctcttccaatgacaaagtccttgcagaaacgcgggaaatcagaatctctttctctgccaaagttttaatgatatacgggatggtatcttcctccgcttccaattcaatgatgcggctgtctttttgctgtacttgaagaataccgtcctgctctaatatttctttcgcccttgccggatgatcgaccgtgacggtaaacagctttttctgaccaaggtcatttctgctcttcatgtcttcaattcctaaaatccgtccctttttaatgtaggcaaccctgtcgcaaatctcctccatttctgacaataaatggcttgataataaaatggaaaccccttgcttcgctaaatcggaaagaatgatgcgcaattctttcatacctttaggatcgagaccgttcatcggttcatccagaattaataacccgggattgtgaagaagagaataagcgagccccaagcgctgtttcatgcctaatgagaaatgtttcacttttttgcgggcagcctgctccagtccgacttttgcaagggtattcataaggtcatccgttcgcagcgaggtgctgcgcagtttagtaaaatattttaggttttgcaaagcggtcatattcggatacatatccgggccttcaatgataaccccgatatgtctcataaaatattcaaagtcgctgtccggtctgcctctgaatgaaatggctccttctgtttttttaataagctgtacgatcattctgaaaatagtggttttacctgagccgttcggccctaaaaggccgaatatctcgccttttctcacatcgaaagaaattgactgtacaataggggtatgattgatggttttagagacatcttttaatatcagggctggttcactcatgctacttgcacaccttccttatgatttagggtaaaagccgtcaaaaccgaagaacatgcttccgatcaggccggcagcgattaaaatgagagcaatgctataccacatttttcgattcaatggtttccctccttacaatgctgacattccatttgaaatagcgcaaaaagatgcggaatatcagtttcgaaagatcaaatccggccataaacaccgccatacccgctccgaggaccatacatccgttaaaaatggctgttacaatcggcacttttatgaggagaaagaatgatccggtcatcagcatcaggccgattgccatcaaacttaacaccgcaacagaggcaaaaagaaacggtgtcagcataaacatgaagttgaacatgcccatacccagcatcaggccgaatgctttgaaaaaggagcgccatgttttctgctcctcggcatcactgatgaaaatatccgcttttaaggcgcgcgcaagtgttttggggtttcctaaattgccggcgatttgttcatcgctttttccttcagcgacgcccatttggaatatttcgccgatatcggcgagtatctctttttgctcaaattccggcagatcttttatttcccgccggagatgttttaaatattggtctttacacattcattttccctccttaatgatgctgttcactttttcggacaggtcaagccattccgattttaatgtgtgatgataaaaggcgccttcttctgttactttgtaatatttgcgtgacgggccttgatctgaagctgctgtatacgtttttaaatagttatttttcgtaagtcttcgtaatatggggtagatggtgccctccgatacagggaacgtttcacttatgaccttgattaattcataaccatataaatcttcataaagaagcagggacaacacacaaagttccaatgctccttttcgtaattggctactcatttactatcattcccatcatatctaataattgtattctctatacagtgtattgcacagtagctaatcgatcaataattcccaagaaccatttgggatgaggaattgaatctttatgcttatgtgcgggcggggaccgagatgcgcagcccttgcgggaagaaggcctcctgaacaatgtttacattaatatagatcaggatgcgcgtcattgacaaatggcaaaaacccctttttccatgacaagaaaaggggttttttgcgttattcggccattttttctaaattgccgttccggtccattttaaaggacggagacgcatgctcgtcgtcttcaaataaaactagttttctggctctgttcataattttcaccaaggtttcgtagtcttcctgaatggttttttgatctttttcaagtttttcgacggccgcttccagctgctcggttttagactgaagttcttggttttcccgttttaaacggtcattttccatctgcagggcggaagtttgctttccgctgccttcatagctctgcagaaattgaatgacgtctgccattgtgagctccgccttttggctcggctgctgaggcgccagcaaatgtgataaactagctaactcttccttgaagctttcatcgacataaggcatatgttcgccggacatgacggcttgccgatcctcttttggcgcttccgtttgaaccgtctcttcggctgcggtttcttgaatgatgtccgcatccggtgcaggcggctggtataatagtttcttcttggccggctggccgtttccgagcgcgcgcatccgctgtttccgctgtttttttgcaagctgaagcgctttttcatattgatggcgcacgacggcattccatctgaatccgcacgctgccgacgttctgtttaatttatcgcctacctcttcaaaggcgttcagctgcgtgcttccttcccggacgtgccggagcacggtttccgcaagcagcaggtcattttcctccgaccaggcgtcctgtctttgctttgtcaatgttctcaacccccaataatctttgatggtattagaatgtccagattggaaaatatttatacaaattggctgaaagaatgagagatacgcagagccttgcaggataagatgaatccttgtacaataaaacgtgatgtgatttttttcgtttttaaaatttaagatttaacatagaggaacattgaatgaagggaagcgtacatcatggctaatgaattccgagtgtgtgatgattgccaggccaccaatattaagacattgctgccgcgtttgaaagaagctgacccggatgcaaaagtggaggtcggatgtcagtcatattgcgggcccggacgcaagaaatcgtttgctttcgtaaacaaccgcccgctgtcggcgccgactgaggacgagctgattgagaaagtgaaaaagaagatcaaaaagtaaatgtgcatttttacgacagcctcgcccgatgggtcaggcttttttgcttcaaaaaatcaatgattgaaaactggaacaaaacgccggacaaattcaaggatgttttcaaattacagagccgatataatagaatcacggctaaaaaaaagagggaatgacgatggcgtatccaaacggaaaattatcagaagaaaaagtgtttaaagatcccgttcaccgctatgttcatgtgcgggacaagctgatctgggatttgatcggcacccgtgaatttcagcggctgcgccggatcaaacagctcggtacgacgtatttgacgtttcacggcgcggaacacagccgttttaaccattctctcggcgtctatgagattgtcagacgaatggttgatgatgtttttaaagggcgtcctgaatgggatgacaatgaacgcgaactctgtctcagcgccgcgcttttgcacgatttgggacatgggccgttttcgcattcctttgaaaaggtttttcatctggatcatgaagactatacgagggaaatcattctcggcgacaccgaggtgaatcaggttctcagaaaggcgggaccgggatttccgcaggatgttgccgaagtcattgccaaaacatacaaaaacaaacaggtggtcagcctgatttcgagccagattgacgccgacaggatggattaccttcagcgggacgcatactatacgggcgtcagctacggacattttgatatggaacggattttaagggtcatgcgtccgcgagaggaccagatcgtcattaagcaaagcggcatgcacgccgtcgaagactatattatgagccgctatcaaatgtactggcaggtgtattttcatcccgtgacgagaagcgctgaagtcattttgacgaaaattctccaccgtgcgaagcagctccatgaagaagggtatatattcactcatgctcccgttcatttttattccatttttgaagggaagctgacgcttgcggattatctgaagcttgatgaagccatcattttatattatttccaggcttgggaggaagaagaggacccgattctgtccgacttgtgccgccgcttcattaaccgccagctgtttcaatatgccgaatttaatccgaatgaggaaatgtcggcttattttgaactgaccgctctctttaaagaggcgggaattgatcccaattactatttagtggtcgattcttcatcggatctgccgtatgatttttaccggccgggtgaagaggaggagcgtctgccgattcatctgttaacgcagaacggccagatcaaagagctgtccaggcagtccgccattgtcgaatccatttcgggcaaacgccggacggaccataagctctactatccgatggacctcatttgcgacgattcagaaaaccctgaagcaaaattaaaaatccggcagctgctgggactgacatagaaggattttggtaaagaaggaaaaggagatgtcgggaatttgttgaaagaacatgcaaaactgatgaaggtgttctcggattctggagaaatcatcgggcggaaaaagctgcagaaaatcatttatatcgcgaagaaaatgcagtatcctttctacgaaaaatatgattttcatttttacggcccgtattccgaagaactgacgcttcgaattgaagagctgtgcaatcttgggtttctggatgaggtgaaggaaaaaaagggcggctactttcaataccggtactcgctgacggagacgggagccgagtttttacatcatgcggagcttaagatgccggatatgaagaagtacatcgacagcgtcaacagccgctcatcccggtttctggagctggtgtctacgattttgtattttgacggccttgaagctgaggaaaagaaagagaaagtgtttacgataaaaagcaaacagaaatatacggatgaagaatatgatgaggcgcttcactacatagaagagctgaaacacatttgttaaaggcgatgctttcgtctttttttatgaaaaaaccaggccgcgatgaagcgggcctggttttgtttattgtctcaatttgctgtgcttgtacgaatataaaaagtaaacgatgacgccgatgatcagccagacggcaaaataaagccacgttttcagcggcagattgaccattaaaaacaaacagcagataatggccaaaatcggcagtacgggtacaaaaggcactttaaatccccgtggcagatccttatgggtgcggcgcagaatcagtacggacagactgaccatggcaaatgtcaatagcgcgccgatgtttgagagatccgacagctctttcagatcaacaaaacccgcgatgcatgcgctgatcagtccgatcagccacgtattaaagatcggcgctcccgatttctttccgacaatggtaaagactttcggcagcattccgtctcttgccatcgcaaaagatatacgggtcgccgcataggtatgagcaagaacgacggccatcagtccgatcaccgcaccggcagcgataatgcccgccaccgcgttttgtccgacagtctgcagcacataagacatggcttccggcacattaagctgtgaatacggaaccatacccgtcatgacgagacagacgatgacgtataccaatgtacagatcaccagtgaaccgataataccgatcggcaggttgcgctgcggttttttgacttcttcagccgaagccgaaatcgcgtcaaacccgagaaacgcaaaaaagacggcagaagcccccgtaatgacgcctttaattccaaaaggcataaaaggatgccaattgcccggctttacaaaaaagcttcctgtgatgataaacagcaaaacaattccgatttttacgagaaccattatattattaaaggttttgctctctttagagccgcgtgacagaacgacggcaattaatagagtaatgatgatggcaggaaggttgacgatcccccctggctcggcacgtgcagcagactgtccggcaaaggcatgccgatttcggctaacagattattaaaataacttgaccagccgcttgccaccgctgacgccgtcaccatataaacggataagagcgtccagcccattaaatggccgacaatttctcccatggtggtataagagtaaatataggcgcttccgtaaaccgggagaacagaagcgatttcggcgtaacataatgctgcaaggctgcagacaacggctgcaatgataaaagaaaagattacggaaggcccggcgtttttcgcggctgtaatgcctgtaagaaccatgacgcccgtcccgatgacggcgccgatgcccagtaatgttaaatcaaatccacccatcgttttggcagtctgcctttttctgctttgttcaagcagctgggtgatgtcttttttttgtaggatattccgcaacacgcatccctccatccaaaagcaaaagccaagagggactctttggcttttacccgtgtcacatcttctgtgtaatcgacaatcctgtgttctgtttccccgtctgttccgtttcttttcttttccaatcatattgtctgccgcatccgatcagattatccttaccgtcaaacgcagtcacccttaatgattttacctgaatcgtgtctataaaaccagcattgcataaaaggatatggtaaaaaagagggagacaaaagtctgtgcagggcaggataaaagttgcgggcattccggccggaattttgactttctccgtaaggtatcagtaaaatgtaataaaaaacaaacaaatgatgatggatgcatcttgaaatggggagtttctgcatgaagcacgataacttgcaagcaaatgtactggattacgcgctcacgaaatatttaaagagcacgaaaaagcttgatgaggcgacaattccaaagagtataaacaatatcagaggatttattctgaggattatttaccggcacggcacgtgcacgattaaagatatattgcaggaggtcacattatcgccttccgccacgacaaccgctctcaatcatttagaaaaagaaggattcgtggaaaggtcgagaaacaatgaagaccgccgcacggtatggatgacgctttccgaatcgggaaaaatggcggccatgcaaatgattgaaaaccggcagctgctcattgacgaactgttcgaagcattgacagaggaagaaaagaaaatctttttcagcctggttgaaaaggttgtgaaataagccggcctgacatagcagcgccggccattatcaaggattactccgtatcgctgatccgtttgccggcgacggcgtaatgatcctttctcatttcttcaatcatgacaatgatcttttcttcggctgcgccagtcgtttcttttacggcttcggtcactttttcaaccagattccgtttttgttcatctgtgcggccttcaagcattttaacggttacgagcggcatggtgctgatcctcctttatcgtttcctctctttggaagagagatcacttatagtatactgaatgaaggacaatcttgcatttttaaaaaaaggggattttgacatttggacagatttttatattatccgctggagcttatgccctatgtcgtgattacgctgatcgtggcatttacgatgcatgaactggcgcacgcgtatgtcgcgtatcggttcggagacgataccgcggcgagacagggcagattaacgctcaatccgattaaacatcttgatgttttcggaacgattctaattttggtcgcgggtttcggctgggcccgtccggtgccggtgaaccgccgcgcctttaaaagaccgcggctggcgggagtgctagtttccgtcgccgggcccgtaagcaacctgcttcttgcctttatcggtttctttttgctagtgttgatgcatgcttacggaatggagctgctttctgcattcagcatggggcttgaccgctttttctctatttggattcagctgaatctcgcgctgtgtttattcaacctgctgccgcttcctccgcttgacggctaccggattattgaggatctcgtgccgccgcgggtgcgcgccaaaatgactcagtttgagagctacgggattatcgtgtttctcgtgctgtttgtgacaccggtcggctcctatgtcgtgtggccgctgttaagcgaggggagagactggattctcaaggtatttgccattatatttcaaccgcttttgtaggagggtattttcatggaagaaaaaaagaagaaaacaatcggatttaatattattaaaagtgatccgaccgacggacatggcggttttggcgccgggtcgctgagccttgacaatatttctccggtatttgtcgatgtggaagagaaggaagctttcgtagacatcggcgcaatgcatgcccgcagtgtcgttgaaaaaggcatcaaattcctgccgaacaaagatgaagtgccgaacggaaaaccgtactggctcgtgtgggtcaccatcgacagaaaaaaagaaggcccttattacgcgggtgtgacggcttgtgaaatgaccgtggacagaagtatccgcagaggctataagtcattgccggagcatgtgaatttaatggataaatcaatgaagcgccgcattatcgtggacaaaatggacgccagctcaaagcaggtgcttgctgaatttctgcagaagcatgaccaagggctctgggaacgttcatccgatgaattgaaaacaggtctgcttccgggcgaaaaataatttgtgaactttttgtgaactttataaatatttgcactatttcgcaattgtactgagtaaactgttgatacagaatcaggacatggaaagtcccgagccgaaccaagactcggggtttttcatgtttacgcggaggtttcatcatgttcaccgtctttgacatcgggccttggatcattgaagcagatacggcggaaacgagaaaacaatatgaaaaatcatgggctgatccctgcgattgcgggagctgccggaacttttccgaggcggtgaatctccttcccgccgagaaaacaagattgtttacgcagtttgggattcgtccggctgtctgtcacgatttgggggagcatggaaaggaaaacggcctgcatcattatgcgggcagctatccgattgtcggcatgcttagggaaggctggccgaagtttcacattgagagagcgggagatatccgcttttcgttttctttgcctagtacaacattttttataccgaagggttttcctgaccctattatccatctcgacttttcactcttgctcccatgggtgcttgaggaagacgcggattaagcccggcgcgcaatgcaccgggctcagtcttttttgccgagccacttatcccaccactttttgcgcggagcttctttacgggcggggacgtgttccttttcttttttagacggttccggtccgtagcacacatccgcgggctcagtgcctgcgatgaaatacgtgtaatgctttgcggcgcatccgggtcccgaagtgtagccggaagcggggtcaatatagacgcccgtgacgcccttcggcggtttaagcgctatttccggttctccttcgagcgccttctccataaagtccgcccaaatcgtcttcgcatagcttttttcttctactgaatcaatcgtgctgcttttgtcatagcctgtccacacaccggcggcaagagcccgattaaagccgatcatccagctgtctgcgctggtcgtgcctgatttcccgccgtacgtccgggtcagccggtctgaaatggtgcgtcccgtgacggaagtatagccgtttaaatcctcatcaaacatgcccgtcatcatgctcgccgtcacaaaagcggcttttttatcaagcgtctgctgatgtccgcgcggctgttcatacaagaccttgccggcggtatccgtcacttttgtgataaaggaaggggtgatttgttttcccccgtttgcgagcatcgcataggcattaaccatctcaatcgggcgcacgggttcagttccgagcgccagagacggaaggggctttaaatgttcgctgatgccgaattcctttgccgccgacacgagcttattcatgccgagaaagagatgggtcttcacggcataaatgttgtctgataacgcaagcgcctgaagcagcgtaatcggtttattggcgtagtagccgttgtaattgcttggagaataggtatctccgttgtcgtcaatctggaactctgtggcttcgcttttcatcagcgtgaccggtgtaaagccgctttgaatcgctttgtaatacaaaagcggcttgatcgtggaagccggctgccgtttcgcctgtgtcgcccggtcaaacgggcttttttcgtagtcacgtccgccgagaagcgcaagcacgcgccctgttgccggatcaatcgcggaaaagccgacctgaatgtcagagccggtacggatcgtatgtgccacagtgttttccgcgatccgctgcatgcgcttatcaagcgttgtataaacacgcaatccgctcgttgcgagctgttcgcgcgtcatgccgagctttttctcgagttctttcatcgcatcatcgtaaaaataaggcgccgttttcgccgcggttctgcttttcagcggctgataggcaagcggcgttttcttaatcctttccgccttttcttttgagatcattttttgtccggccatcagacggagaatggtttcctggcgctgtttggccttcttttcactgacatatggcgaatagccggacgggcctttcggtatgcccgccagaagcacggcttccgcatcgttcagatctttggcgtgtttgccgaaatacaggcgggaggcggcttcaattccgtatgcgccgtggccgtaatatatcgtatttacataaccttctaaaatctcgtttttggaatagttctgttcaaggcggatcgtgtaaaatgcttcgttccattttcgtttccatgttttatcatgctcaaggtagagatttctcgcgtattgctgggtgatggtgctggcgccctgaaccttggccattgcctttatgtcagccagcgcggcggcggccatccgccggtaatcaaaaccgtggtgattgtaaaagttttgatcctccaccgcaatcgcggcctgcaccgctgtcggattgatatcttttaaccgaacccagtagcgcttttccccgaaatcggtctcacctagctttgagccgtcatttgcataaagaatcgtagactgaggaacccggacggagggggcgccctgccatttcgctgcaagaagaacggatgtgaagcagacgccggccagcattccgccgatcagtgtcagaaagatgcaggcgcggatgattttgaacgtgattctgagctgttttccagatactttatccacttttgggaaccccctttttcatgattctattattatgtgaaaaaagggggttttttaaacatatcaaaccggacacttctttactttttcccctccatcctctatactttttccttaggtgaaaatgagattttaaccggaataaaagcgatacagacgcttacaataaatgaaataagccttgaaagggagatgacaattgagcgagctttggtatacggagaagcagacgaagaatttcggcattacattaaaggtgaaacaaacattacatacggaacagacggaatttcagcatctggaaatggtggagacagaagaattcggcaacatgctgttcttagacggaatggtcatgacatctgaaaaagacgaattcgtctatcatgaaatggttgcgcacgtcccgttatttacgcacccgaatccggaaaacgttctcgttgtcggcggcggagacggcggtgtcatcagagagattctgaagcacccaagcgtaaaaaaagcgacgcttgtcgacattgacggcaaggttattgaatactctaaaaaattccttccgtccattgcgggcaagcttgatgatccgcgcgtcgacgtgagagtcgatgacggtttcatgcacatcgcgaaatcagaaaatgagtatgacgtcatcatggttgattcaacagaaccggtcggaccggccgtcaatctgttctcaaaaggcttctatgccggaatttccaaggcgttaaaagaagacggcatcttcgtcgcgcagacggacaacccgtggtttacaccggaactgattacaaacgtacagcgtgacgtgaaagaaatcttcccgatcacccgtctgtatacggctaatatcccgacgtacccgagcggcctgtggacatttacgatcggttctaaaaagtacgatccgcttgaagtagaggacagccgtttcttcgacatcgacacgaagtattacacgaaagagcttcacaaagcggcatttgttcttccgaaatttgtgagcgacttaatcaaataaaaacgtacggcgcaggagcgaatcttgcgcttttttacaggaaagcgagggaattattgatgagatttgatgaagcatattcaggaaaagtatttatcgcgagccgccccgactggaaagaggcggacgccatcctttacggcatgccgatggattggacggtcagctaccgtcccggttcacgattcggcccggggagaatccgcgaggtgtctatcggtcttgaagaatacagcccgtacctcgaccgtgacttggctgatttgaatttctttgacgccggagacattccgcttccgttcggcaatccgcaaagaagccttgatatgattgaagaatacgtggacggcatcctagaaaaaggcaagttcccgctcggcatgggaggggagcaccttgtatcatggcctgtcataaaagccatgtataagaagtttccggatcttgccatcattcattttgacgcgcacaccgacctgcgcacggattatgaaggcgaaccgctttcccactctactccgatccgcaaagcggccgagctcatcgggccgcaaaacgtattttcattcggcatccgctccggaatgaaggaagaatttgaatgggcgaaagaaaacggcatgcacatttctaagtttgaagtgcttgagccgctgaaaaaagtgctgccgcagcttgcgggacgcccggtttatgtcacgatcgatatcgacgttcttgaccccgctcatgcgccgggaacgggcacggttgacgcgggaggcatcacgtctaaagaattgctcgcgtccatccatgaaatcgcgcgctcagaggtcagcgtaaaaggcgccgacctcgtagaagtggcaccggtctatgaccactcagaacaaaccgcaaacacggcaagcaagatgatccgtgaaatgctgcttgggtttgtgaaatagaaagaatttcccccgcttgaaacatggcgggggatttttatattgtatataaactacttagaagttagtaaaagaaatatattattttactattaataattgatgttattgataaaaattatataatagggtattatttagtaaatacatctttagaaaggaagttagaatgaaaacagcagtagaaaatgaattggaattaaaaaagattgaaatttcagtaattaaactgataattgctgaaaagcctaataaagagatcgctaagtcattaaactactcgcagcgtaatgtcgaatatatcatagccggtctttgtaaaaagtggaatgtaagtactagagtcggtattgtttcggaagcatataaaaggaattgtatacagtgaacgaaatgaaagaaaaacccctattgagggggtttatttatatatgctaaaaaaacattctatacaggaatgccgtaaaaataaaaactgagattgtcaggtagttcaaatttgttctccatttcagaagaataaacaaaagaaataagtatgcaatattgaacaaatcaaagatagaaaaaatcaaatgattacttgtgaaaaataaactagtgtttggatgttgtgcgaaaatatttttgaatgatataagaaaaaacttaatcgcgaccgggatgttagaaaacataaatagggaataaaaagttttgatcttaatctgagcgccaagaaaatttataatgagaaataatacgaatccttcaaaaatgaccccgaacattaaaagaaacagtgcggctattgcaatgatgtaatctaaatgttttacttgctcaacaacttgtatagggatgtttttgggaattaaacttttcataaaaggtaaaagggaacttaaataaaaagctaacccgataatataaaacaaaaacgaggacaaaaaattaatgtttcgttccttaaatgaagataattcaatttgcataatcctaagaggctccttttataaagataggtgtaataaatgtttctaacatagctgctatcattaaaccgagaaatataataccaatatatttaaaagtgaatttcaaatttattttgaggagtaataaatctaaagttaatttcattcctacagaggctgcaagaagcaataccggcacttcaattattccatggggtataacaagcagtaaaaggtttaaattgtctttaatgtttcctatcgcatttcctaaaattaatccattaataattaaaacagcaaccgtgccaagcgacagcgttaacgggcctaaaaaaacaagcagactcgctactttaatattattaaagaaaatctgaaaaaaatccggacggatatttcgatttagattatttacatttgaagcggaatctgtataaatatatgctgtaaataaagcaattaaaaataagatcagacagagtatgtacaatttgactaaaacattctttttaaacaatgtattttcatccattcgttaaagggactgccagggatattgaatttaatgttttatattatgctgctgctgtacttgctgcagccaattgttctaaaacggccaatggcaagcctgcaccaagagatcctaaaacagtaatgatagccagaactgatcccgttgcggtgatagcactgacaatccaactaggagcgataattccagctctgtttaaaatatcgataacatccatgcttaaatgattatgtttcatactgaaaagagcgagaacaatgattcctgatgctactaatgtaaaaatcgctttactattttgtgtttttaaaagtagattcattttttcctccaattttttcaatatccccagcaagttaaataataaaatatattggaatctatttgaattgcggatttccgaaaaaataatagttaagaggtgaaatccgtaaaagtatctgctggcttatttcgtacaaagaaagccggaccatatgtatgatccggctttctttggtactgaaacattatacttttttttcaaaaataatatcaaaataatcagctgccccatagcctgaaatagcaggagcaaatatttgaaccagctttcacccttgctgcgaatacttttcaataatttatttatagtcttctttaggctttcctttccatcggtttacttctgcttttatgaacttgtattcgtacattgctgtataatcctccggaagtgtattggaatcgttaccttgtttttcgattttgataaacttgaatccataaatagagcgcgcagcctattaaaagaatcggaaattgccatcctgtatttccgtttttaaaataatctattaatgaccatatcagtaaagcgacagtataaaaactaaatgctattctggcggctgtacccgattggtgtttttgcatctcatccattttcttcataagaaccgctcccttaattttttttggcgttatagttgaatactttatctattcccgtatttaaagcgtgagctatcgaaaaagccagacttaaagtcgggtcatatttattattttcaattgcattgatggtttgcctggtcacattgcagagcttagccagatcattttgtgaaatatcagctgctgttctaagtttttttatattgttatccactaaaaccctccttaacttattttgttttttattttaaattttcaaatttatatatatttattttaaataatatatgtataagtgtcaaatactttttacacatttgagttctaaggtatgttttttgtttttgtaaattagttgtttatataaaaaacggcttgcagtttaacctgcaagcctaaaagtaattatcatttaaatcatagctctttgtgctacttcgaattggtgtgaaggtgtattcgtcatatctgctgttataaaaactgaggttacagctaagcaagtgagtaagaccttatacttcagcttcataaaaagttaccccccttgaatatgctgtcttgcttcttcaacttttaaaaagtatgttgaagcttttttataatcttcaagtttgtgataatatttagctgcatcaagagcaaaatcttctatatctgcatacatcatcttactttccaaaaagtcaaaactccttttcattgcatcctcatcaggtccgttcacatacaaagattttaaaaattcgaattcatgtaaataaactgaatctgctgactcttcggaatagataactccttttttatgatactcgagcgctttgtcgtatctttctaatttataatgaatctgtgtcattaaaaaatatgcttggggcaaagaaggggtcattttagcactttcaaaaacatcaatggctttttcaacataagttatagctgcttcatagtcgttcaggctttgtttgcaaagtgcgatgttatacagcgtcctgcccattaattgaggctgtttttctgtttctgccaaagaaaaagccttttgaaagtgagtaattgcccgatcatatagttttaaatccaggaaatttgctccgaataaggattggcattgtatgagcctgatatcgtatgacgactgagctttatatatttcatatgcctgccttgcgtaatcggtagatacatacgtttgtttcaaatagtagtagacttcagacatcttgaaaaagtactcggctttatcaatagtatccttaataaatgagagtttcgtctcagcctttttaaaaaattttatagccgacaaatattcccgctgatccagctcatacatcccccggaaaaaattaaaataataatcaagccgtccggtcagccgggcctgctttttatcaatatccgcgagcagatccgatagtctcggctgttcttctatccgctgcgattccagcggttcgaggtattcgagcatcagattgtggcggaattccatgagagaatagtacagatgaagatcctgatcttcttccaggcctgcaagctcttctttgatttctctccgcaagtactcggcgtccgggatgctgaaccttcgaatgtacatataccattcgttgattttttctccaaccgctgaagacgataaaacactcgccactattccgaatccctcccttccacgttatgtatatgacatattttatcattttcattcggaaggatagcgcaaaaataccgcaaacttttcccctttgacaaagccgtccgccgaaggaaccgcatttatcccgcagcctaggatttccggttttttcattttccttaaaaatcatgtttatcttcaaaaccaatcagcaaagatggtaagataggaggaagcggttgaactttttcccttgaaaacttatactattcaggttaagcgggatgatgaaaaggaagtgtcagcatgagacaggagacaccagtagccattcatgtgcaatcattcattcataacggctccgaagaagagtcggttgaatttacatcgagtggattctattacgtgagaaacggcaaaacgtatctttcctatcacgaagagcatgatttgggcaagattaaaacggtcgtcaagattacagaaaaagagattctcgtaatgagatcgggcgccatccaaatgaaacagcggttcattccgggggcatcgacactcactcaatataaactgccgttcggacaaatggagctccgtacggaaacgaaaaacattcaatctgatgtcggcggttcggaaggctccgtcaaactgacatataacatgactgtaggcgaaaaccaagaacatgtacataacatgacgatccaatataaggaggaaacaaaggcatgaatattgcggaacaaatgaaggacgtgctgaaggaagagatcaaagcggccgttctgaaagcgggcctggcggaagaaagccagattccaagcgtactgttagaaacgccgaaagacaaaacacacggtgattattccacaaacatggcgatgcagctggcgagaatcgcaaaaaaagcgccgcgccaaatcgctgaggagatcgtggcgtcatttgataaaggcaaagcttccattgaaaagatggatattgcggggcccggctttatcaacttttacatgaacaacagctacttaacaaaactgattccgtccgtgcttgaagcgggtgaacattacggagagacaaacatcggacaaggcgaaaagattcaggtcgaattcgtatcggccaacccgacgggagatcttcacttaggccatgcgcgcggcgcggcggtaggtgacgcgctgtgcagcgtgctttctaaagcgggctatgatgtgagccgtgaatactatattaatgatgcgggcaaccagattaacaacctggcgctttccgttgaagtccgttattttgaagcgctcggcctcgagaaaccgatgccggaagacggttaccgcggcgaggatattatagcaatcgggaaaaagcttgccgaagatttcggcgaccgtttcgtacatgaagaggagagcgaacgtcaggcgtttttccgtgaatacggcttaaagtacgagcttgataaacttcgctccgacctggaaaacttccgcgtgccgtttgacgtatggtattctgaaacgtcactgtacgaaaacggaaaaattgatcaggcgctcgaggcgcttcgcgaaaagggccatgtatacgaagaggacggcgcgacatggttccgctccacaacgttcggcgacgataaagaccgtgtgctgatcaaaaaagacggctcatacacttatctgctgccggatatcgcataccataaagacaaacttgaccgcggattcgacaagctcatcaatgtatggggcgcggatcaccacgggtatattccgcgtatgaaagcggcgattgaagcgctcggttacaagaaaggcacattggaagttgagatcattcagctcgttcatttatacaaaaacggcgaaaaaatgaagatgagcaaacgtacggggaaagccgtaacgatgcgcgacctgattgaagaagtcggcttggatgccgtgcgttatttcttcgcgatgcgcagcgctgatacgcatatggattttgacttggatcttgccgtatccacatctaatgaaaaccctgtgtattatgcgcaatacgcacatgcacgtatttgcagcatgcttcgccaaggggaggagcagggacttaaaccggcggcagatcttgatttcagccatattcaatcagaaaaagaatatgacctgctgaaaacaatcggcggcttccctgaagcagtggcagaagcggcagaaaaacgcattcctcaccgtgtcacaaactatatttatgatctggcttccgctctgcacagcttctacaatgcggagaaagtcatcgatccggaaaataaagagaagagccgcgcgcgtctcgctttaatgaaggcgacgcaaattacgctgaacaatgcgcttcagctgatcggcgtatccgctccggaaaaaatgtaatgatgatcaaaggacaaagtcttcgggctttgttcttttttttgcatataaagcgtgtgatgtaattcacaatccagcacactgagtttttgtatgataagactgatattgaatcagtgaaaggggcaagccgaatgatcaatcgtcaacatattcaattatcgctgcagtctttaagcttagtggcagggtttatggtgtgggtgctgatttcatcgctcatttctcaaatgacatcagatattcatttaagcaaaggcgagatttcattggtgacggcgattcccgttattctcggatcgcttctccgtattcctttaggatatttaacgaacaggtatggcgcgcggctgatgtttatgatcagcttcatcctgcttttgtttcccgtattttggatcagtatcgcggattctttatttgatttaatcacgggcggctttttcttagggatcggcggagcggtattctccatcggagtgacgtccctcccgaaatattatccgaaagaaaagcacggtgtcgtcaatgggatttacggtgccggaaacatcgggaccgccgttactacctttgcggcgccggttatcgctcaagccgcgggatggaaagcaaccgtgcagatgtatcttgttttgctggctgttttcgcattactgcacgttttgttcggcgaccggcatgagaagaaagtcaaagtttccataaagacacaaatgaaagccgtttaccgaaatcatgtgctgtggatgttgagcctgttttattttattacgttcggcgcctttgtcgcctttaccatctatcttccgaattttttggttgagcattttgggctgagccctgcggacgccggtctgcggacggccggctttattgcggtctctacgctgctcaggcctgtgggagggtttcttgcagataaactgagcccgctccgcattctgatgttcgttttcgcagggcttacgctgtcaggcgtcatgctgtcattctccccggcgatcggcctttatgcgttcggatcgctgacggtggcagtctgctcagggattggaaacgggacggtatttaaactggtgcctttctatttttcgaagcaagctgggattgccaacggtattgtgtctgccatgggcggactgggcggttttttccctccgctgattctggcaagtgtatttcaggcaacgggtcaatacgcgatcgggtttatggcgctttcagaggttgcgttagccagctttgtccttgtgatctggatgtattggcaggaaagaatgaaaacacatacggagagaaacagtcatagccttgattcataatgatccattcacaagattgttagttttttctgggtgagtgcaaatcaagtcacgttacaatatacatacgcaacgtgactttcttcgaggtgagctcatgaatattctctctgtccgaaaatctgataaagaacttctttcccgcgaactgcatgaattgctggaatcgatcagtacgaaaaggaaaatgaaaaaacacacgtatttgtttcaagaaggaatggatgcagaagagctttatctgattcaatcaggactcattgaaatcggcaagctgacatctgacggaaaagacctgacacttagaatctgccaaaaacacgatattgtcggagaattgacgctattcacagatgagccgagatatatgctcagtgcgaaagtgttagaggacggggaggtgctcgtcattaataaaaacaggctggaaaaggaattggtccaaaacggtgttttgacgtttgaatttatgaaatggatgagcacccatctgcgaaaaatccagtctaagatcagggatctgcttcttcacggcaaaaaaggggcgctctattccacccttatccgcttatcaaacagctacggggtggaacgaagcgacgggattctgattaacattgtgctgacaaatcaggatttggctaagttttgcgcggcggcaagggagagcgtcaaccgcatgctgggagacctccgcaaacaaggggttatttcgatagacgaaaccggaaaaattattttgcacaagcgggactatttacgatgcgagatcgagtgtgaaaattgtccgcttgagatctgcaatattgactgaaaaaacaagggcagccggtgtccttgtttttcagcttgtgatacatatacacatgacggcgaaaaagaagccggcatttacgatttccagaatgccgatcgttttcaccggccagtctcttccgtgaaaaaaccaggcccgcagactgcttgggataaaagcgagaaacgcccagcctgccccgagaagagccgataaaaaggggagcaagaggtgatatccccacgaccagtaagcaaaccttctgttttttctctcccgtatgaccgatttcacataaaaagaactcccgacaaaaaataaagcggattgcaagaatagaaaccaagcccagccgtcaaggattcccgttcccagccagcagctcgcaagcccgcctgaacaaaagaacaagactcccgcaatatcattcgtgagcgcccgttcgttttttcggcgggcataatgcgtatgtatgagaaacagcggcaataaaaaaacgccgatccagacgagctgcggcttatgaaagacagaaatgatcaaaaagcagcaggccggaaaaccgtaataccatatccacttttgataaggctgaagctgtttctttttcaaagcgagcgaaacgggataaaccgtcaagtaaaggaacagccagcccagaaagagcggaatatgccagaaaaccgggcctcccttgaccatgccgagtaaaaatggaatcagcagcatcgcccatgcgccgtgctgcttcggaatcatcgctttcatcgaaaccctcctttttatttcattataagtgcaaacactctcctgataagtgactttcatcatacaagctgtgaaatacatcactgccgcgcgggctcaatcgggctacactaaagctatcaatagcacaggaggctttcctatgaatcagtgtgactatttattatttctgaaacaacttcctatgtttaatgaagtgcctctgtccattgtcgaaaccttgctgaaaaacgggacgtttatccgcggctcatctgaccaatctccatcctttcttcattcacaatccgtttatattgtattaaaaggcaatatccgttttacggacagcaggctccctgaagggtcgcaaaccgttgcgctgtgggaaaaaggcgatgtgtttccgattgatgaaaaaggcgggctctctttatcgccttttatctcagtcaatgcctcaccggatattctggtactccatattccatattctatatttaagcaaatgatgtcttaccatccgcggctgcaaatgaactttttggcgatgcttcagcaaaatgtcttctgttcctatcagttgtttttgcggtatctgcatacatcactggatgaaaacgccgaacccggttcttaaacagaaccggtttttttgatgacgcgggcgtcctcatatcgtttaaaaatccttcctgctgctctgtgtgaacgttttgtgaaaaaagcagagtgtgtgacttagttcacaaggtgatgcgccgtctctgtttatagtgtacatagcatcacctgactcggaaggagtgaacgatcatgaagaaaaagaaaatgagtccgttgctcaggagattaaactatttttctcctatcgaacatcattcaaataaacatagccaaacgacaagcgaagatcgtgattgggagaatgtatacagaaacagatggcagtacgacaaagtcgttcgctccacccacggcgtcaactgcacgggttcttgcagctggaatatttatgtgaaaaacggaattgtcacgtgggaaggacaaaacttgaattatccatcaacaggaccggatatgcctgatttcgaaccgagaggctgtccgcgggggccagtttttcatggtacatctacagcccgctccgtgtgaaatatccatatgtgcgaggtgtgctgatcaatttgtggcgggaagcattgcagacgcatcaaaatccgctggatgcctggaaatcgatcgttgaaaaccctgaaaaagcgaagtcctataaacaggcaagagggaaaggcggctttgtccgcgcggaatggccggaagtgctgaagctgatttcagcctctctgctgtatacagtgatgaaatacgggcctgaccggaatgtcggtttttctccgatcccggcgatgtccatgatcagccacgcgtcaggttcgcgattcatgtctttaatcggcggcccaatgctcagtttttatgactggtatgcggatctcccgccggcgtccccgcaaatttggggtgaccagacggacgttccggaaagcagtgattggtacaattcaggctacatcatcacatggggttccaacgttccgttaacgagaacgcctgacgcgcactttttggcggaggcccgctataaaggggccaaggtgatttcaatcagtcccgattttgcggaatcctcaaagtttgcggatgactggctcagtatccgccaagggactgacggagccctggcgatggcgatgggtcacgtcattctgcaggaattttacgtgaatcaagagacggaacgtttcatggaatacgcgaagcaatacacggattttccattcctcgtcaccttatcaaaagaaaatggcgtatacacagcgggacggtttctgcatgcgaaggatatcggacggcagacaaagcatgatcaatggaagccggcggtctggaatgaacagacaggtgcgtttgccataccgcaaggaacaatgggctcccgctgggacgggcagcagaaatggaatctgcacatgatcgatgaagacaccggggaacagatcgagccccgtctctccgtgctcggaatagaggacgaaatcagtacggtgcgcattccgtatttttcaaatgacggaaacaaagtgcttgagcggaatcttcctattaaaaaactggaactgaacggtgaagaggtgtgtgtcacgactgtatttgacttgatattggccaactacggcgtgaaccggggcatcggcggacaatcagccgcatcttatgatgatccccgtccgttcacacctgcctggcaggaacagatcacgggaattaaaagagaagccgttatacagattgccagggagtttgcccaaaatgcgattgatacagacggcagatcgatgattatcgtagggcgggaatcaaccactggttcaactccgacacgatttaccgcgcggtgttaaatcttgttttattggtaggcgcccaaggcgtaaacggcggaggctgggctcattatgtcggtcaggaaaagctccgtcctgctgaagggtggcagacgatcgcaaccgcaaaggactgggaaggcgtgcctaaactgcaaaacggcacctcatttttctactttgcgacagaccagtggcgttacgaagaccagccgatcagtgacttggcttcaccgatcgcttcttcatcccgctacaagcatcacgccgattacaatgtgctggcggcgcgattagggtggctgccgtcctacccgacattcaatcaaaacggcattgatctgtacaaagaagctgagaaggcgggggcggcgacacctgaagacgtaggtgcgtacgtggcctcacagcttcaggagaaaaaactgaaattcgcgattgaagacccggacaatgaagtgaatttcccaaggaatctctttgtatggcgggcaaatctgatctcaagctcaggaaaagggcatgaatattttcttaagcatctgctggggacgacgaacggtttgatgaatgacgacagcgacagcatccgccctgaagaaatcaaatggcgggagcaggcgccggaaggcaagctcgacttgttaatcaatctcgactttcgaatggccggtacggcgctgtattccgatatcgtgctgccggcagcgacatggtatgaaaaacacgatctcagcagcacggatatgcacccgttcattcatccattcgctccggcgatctcggcgccgtgggaatcgaggtcagactgggatattttcaaagcactgtcaaaagccgtttccgacctggcggaagaagtcgatatggagctggtgaaagaggtagtcgcgacgccgctcctccacgacacgatgcaggaattggcccagccgttcggaaaaatcaatgactggagcaagggcgaatgtgaagccattccgggaaaaacgatgccgaatatccaagtcgctgaacgggattacaaacacatttttcataaaatgaccgcgctcggccctcatacggctttaaaaccgagcggaacaaaagggatgagctggtcgattgcggatgaatatgaatcactcaaaaagagactgggagaaaccgattcagacggcgttgccaaaggatgcccgaatataagtgaagcaaagcaggcggcagaagcgattttaaccctgtcgtccacctcaaatggaaaggtcgccgtaaaagcatgggaatcgcttgaaaacatcacaaacctgaagctgaaagacctggcggaagaacgcgaggaagaatgctttacgttcgagcaaattacagcccagccgaaaacggtcatcacgtctccggcctttaccggctcagaaaaaggagggcgcaggtactcgccgtttacgacgaatgtggaaaaattaatcccgtggaggacactgaccggcagacaatcctattatgtcgatcatgaactgatgatggaattcggtgaaacgatggcgacatttaaaccgatcctccagcaccgtccgttcctgagcaagcggcctgatcaagagggcaaagagatcgttcttaattatttgacgccgcataataaatggtccgtccacagcatgtattttgattccctgccgatgctgacgctgttccggggcgggccgaccgtgtggatgaataaagatgacgcaaaggacacggatatcaaagacaacgattggattgaatgcttcaaccgaaacggcgttgtcgtggcgagagcggttttgtctcaccggattcctaaaggaatggcgtttatgcaccatgcccaggaccgccacatcaacgtgcccggcacaaaactgacgaataaccgcggaggcacccataacagcccgacaaggattcacgtcaagccgacccagatgatcgggggctacgcacagctcagctacggctttaactattacggtccgacggggaatcagcgcgatctgaatgtcgtcatccgcaagctgaaggaggtcgattggcttgaagattaaagcgcagatcggaatggtcatgaacttggataaatgcatcggctgccacacgtgcagcgtcacctgtaaaaacacgtggacaaaccgttccggtgcggaatatatgtacttcaataatgttgaaacaaagcccggtatcggctacccgaagcaatgggaggaccaggacaaatataaaggcggctggacgttgaaaaaaggaaagcttgaactgaaatcaggcccgaaaacaaaccggcttgcaggccttttctataacccgaaccagccgacgattgatgattactatgaaccttggaactatgattatgaaacattaacaaacagcccgcagaaaaagcaccagccggtggcgcggccgaaatcgtccttgacgggcgattttatgaatatcgaatggggcccgaactgggaggatgatctcgctggcggccacattacgggtcttgaagatccaaacgtgcaaaagatggaggaatcgatcaaaacagaattcgatgaagtctttatgatgtatctgccgcgtatttgtgagcactgcatcaatccggcgtgcgtgtcctcctgcccgtccggcgccatgtacaaacgcgaggaagacggcatcgttctcgttgatcaaaacgcatgccgttcatggagatattgcgtctcatcctgtccttataaaaaagtctattttaactggcaaacgaacaaagcggaaaaatgcacactctgctttccgcgcttggaggcggggctgccgaccatctgctccgaaacgtgtgtaggcagaatccgctatctcggcgtcatgctgtacgacgcggacaaagtggaggaagcggcctccattgaaaatgaaaaggatctctaccattcccaattagacgtttttcttgatccgaatgatcctgaagttgccaaactggcaaaagaacaaggcatcccggctgaatggatagaggccgcgcagcaatcgccgatctacaaaatgatcatcgattggaagattgcgctgccgcttcatcctgagtaccgcacactgccgatggtttggtacattccgccgctgagcccgattatgaatctctttgaaggaaaaggcagccggcaaacggcggaagatatttttccggctatcgaccaaatgagaattccgattgactatttggcccagttattaacagccggtgatacggatcatattcggtcaacgttaaagaaaatgtctgtcatgcgccagtatatgagagcagtccagacgaataaatccatcgacccggcactgatctccagtgtcggcttaacagaaaagcaaattgaagacatgtatcggctgctggcgatcgccaaatatgatgaccgctttgtgatcccgagcagccatcgagaagaagtgtctgatttatacgctgaacaaggaagctgcggcttgtcattttcaggcggccccggctcttgtttctaacttttgataaatgaggtggaacaagatgaacaccacagaccggcaaatgacattctccgctctttccattcttctctcttatccggatgaagagtggagagccgggcttcccgattggaaggctcttatccatgaaatcggcattcagcaaatccgtgagaaactgctgcactttttagaggcggcagccggcttttctccgcaagcgctgattgaacactatgtgtatacgttcgacttcgggaaaaaaacgaatatgtacgtcacctactttaactcaggcgagcaaagggagcgcggaattgaactgctgcatttaaaaaacacctaccagcaatccggtttcctgccgacagagaaagaattgcctgattatctgccgctgatgctggaattcgccgcggttgcggagattgaagcggcgagaagcgtgtttgagaaatacctgtccaatgtgagggagctggcttcccgcctcgaaaaaaatgacagcctctatgctgagctgctgcacgtgctgcaggccgcgctggaaagcatcggtgtacgtgaaagcactgaagaaggggctgctcaggcatgagcgggcagatcctgtgggggattatgccgtacatggtattgacgatctttatcggcgggcatatttaccgctatcagcatgaccagtttggctggacggcgaaatcaagcgagctgttagaaaagaaaaaacttgcggcgggcagcacactttttcactggggactgctgttcgttgtcggcggacatgtcatgggaattctgatcccggaaggcgtgtatactgtactgggcatttcagagcatacgtatcacaaaatggcgatcggcgcaggcctgccggctgggatcgcggcttgtgccggactagtgatcctgacatacagaaggctgtttgacaaaagaatccgcaaaaccagctcgccatcggatatcctgacgcttattctgctgctgttcatgatgctgtcgggcgttgcggccacgtttctcaacattgactcgaaaggatttgattacagggcaacagtcgggccgtggttcagggaaattgttttgttccggcctgacgcttctttgatggagagtgtcccgctatggtttaagtttcatatcatcatagggtacgtcgtttttatcctttggccgtttacaagattggttcacgtgttcagcctgcccctcaagtatttgacccgcagctatgttgtctatcggaaacgcacgtaaaaatccccctgcaagagggggatttttttatggtgaaaaaataaaaacataagatattttctgccaaggtaatggctgggcggcggggattcctgttatgttttatgtggaaataatatcaacaaaaggagagtgaagaatgaagcggattttcctcattttagccgcctgtctgatgacaagcgccggcgtcctgacactcagacattctcatgtattaaccggcggcacagcgggactgtcactaagcctgtcgtacttgtttcattcctcatttgcgattatcttctttctgatcaatatcccgttttatatattttctctcatcagaatgggaatcaaattcactctatccaccgtttttgcagtcactgtgctgactctgtttaccggcgcggatcactggctgccgccggtctctgtttcaccgcttgccggggcgatttgcggcggggcgctgatcgggttcggcctgtcgctcatgttttatcatcaggcatcgctcggcggcgccaatatcctcgctttatttctgcaaaagcgctgcggatggaatccgggtgccgttaatttcctcttcgattttggcgtcgtgctggccggcattttttccgtcggattgctgaaagggctcttctccttagtgtcgatagcggtcaccggtctgatcatcggcatcttcaaaaataaaatcaaaggcagctgctcgctcaatccggcattgcttcagaacatcacaaccggccagtcacaggaagtgtcatcataatcctttccgctcgtgcggagaggatttttcatatgtttacaggccggaaaacagagggtatacagagatatcggatcagatgggagagagtcgggatgctgaaaaggagactggaattttgctttttatatatgatgcttatcggagcatatgtcatatggttttttccggtttccaggcttgagttttacggagggttgctttgctatgcaagcattattttgttcagcatctattcgttaattcttgaaaaccgcacctctcagcacacgctgttatggattcatattcttgtgttttttccgatcgccgggtacttattttaccttttttccggccagctttatgaaaaaggcaagctgttcaggtcgaaacggacatacaaccgggaaaagctgagaacgatatttgatatggaacagacgcccgatctgtccgggctgaaaggaaatcagaagcgtttctttcaatattcaatcaaggcgtctcatatgaatatcaatacaaaaagcaggctgaaggtgctcaaaaacggggatgaaacatttccggagctgtttgaagcgctccggtcggcagcatcatttatacatattgagtattacatgttcaaatcagacatgcttgggcacaagatgatggacattatgatggaaaaagcgcgtcaaggcgtggaagtgcggtttttgttcgacgcggccggcagcctgaagctggccggaaaagacattaaaaaactgaaacgcgcgggcgtgaacatcgtcccgtttctgccgctgaaatacggttttttcaaccaaaagttcaatttcagaaatcaccgcaagatcgtcatcgttgacgggaaaaccggttttgtcggcgggctgaatgtcggcaaggagtatatcggcaaagaccaaagtgtcggtttttggcgggacacccatatgaaagtcgaaggagaaatcgttcagacgctccacagcatttttatgcttgattgggaatacgtttcggatgaggtgctgattgatcagaaagcatacagccgcccggtccctgcagaaagcggcggcgtctatcaagtcgttccgacgggccccgatatgaaggagcggatgagcgatctgtattatgccatgatagcggcggccgaatcatctgtatggatcgcgacgccttatttcgtgccgaatgagccgatccgcacagcgctaaaggaggctgctgccagaggcgtccgggtgcgagtcatggtgccggaaaccaatgacggatttttaacccagtacgcgacgagatcgtatttccccgagcttcttcgcgaaggaatcgaagtctattcctatcaaaaaggctttatgcatcaaaaggtgctcatcactgacggaaacctcgcctctgtcgggacggcgaacatggacatgagaagctttcagctgaactttgaggtcaatgtcttttttacagatcaaaaggcgatcaaagatcttgaagcgcattatctggaggatatgagagagtctgagaaaatcagccccgtccgtttctataagcgcacattatgggaaagaacgaaggaatccttcgcgcggttattttccggcgttttataaaaaacgcttttaaaactccttgtgtatagtataattgagaaatattatcattaggaacgaggcacaaggaggacggaaacgtgctgcgacaatttttttcttattataaaccgtacaagaagctgttttttctcgacttcttttctgccatcgccggcggattgatggagctgagttttcctctgattgttaattactttatcgatacattgctcccgggcgggattggcgtctgattattttgacttccgctgctttattcggagtctacgccctcagctcggcgcttcagtatgttgtgacgtattggggccatatgctcggcattaacattgaaaccgatatgcgtaaaaagctttttgaccatctgcaaaagctttcgttcaaattttacgataacaacaaaacgggcagtttaatgtccaagctcaccaatgatttgatgtatatcggagaaaccgcccaccacgggcctgaagacctgtttatcgcggtcatgacgattttgggcgcgttcggtgtgatgctgttcattaactggcagctcgcgctgttgacctttatcattatgccggtcgtcatttggcttgctttgtatttcaataaaaaaatgacctctgcgtttacaaaactgaacaaagacgtcggagacttcagcgcgagggtcgaaaacaatatcggcggcatccgtcttgttcaggctttcagcaatgaagcgtttgaaacgcagcggtttgacgtgaacaatcagcgtttccgcaaaacaaagctgacgtcatataaaatcatggcgaaaaacggctcgatcagttacatgctgacaagattcgtcacgctgttcgtcctgttgtgcgggacatggttcgtgatccgcggatcgttatcttacggggaattcgtcgcttttgtgctgctgacgaacgttctgttccgtccgattgataaaatcaacgcaattattgagctgtatccgagaggcatagccggttttaaaagctttatagaaataatggaaacggagcctgatatcaaggacgccccgaacgcgagacatgtgtccggtttaaaagggaatatccgttatgatggtgtgtcattcggttacgaagaaaacagcccggttctgtcgggaatcaatttgtccattcatgcaggggagacagtcgcattcgttgggccttcgggagccggaaaatcaacgctgacaagtctgctgccgcgtttttatgatccgtctgaaggcgtgatttccatcgatggaattgatattaaggacatgacgctgtcatcattgcgcggacaaatcggcgtcgtccagcaggatgtctttctgttttccggcacattgcgggaaaacattgcgtacgggcggctcgatgcgtctgaggaagaaatccggcaggccgtccgccaggcgcatttagaggagctggtaaacgggtatcccgacggtttaaacacggtgatcggcgagcgcggcgtgaagctgtcaggcgggcagaagcagcggctttccatcgccagaatgtttttgaaaaacccgtcgatcttaattttagacgaggctacatcagccctcgatacagaaacggaagccgccattcaaaaatcgctgcaagagctgtctgaaggacgcacgacgcttgtgatcgcccatcggctggctacgattaaggatgcggacaggatcgtcgtcgtcacgaaagaaggcatcgctgaacaaggtcatcataaggaactgctggcatccggcggcatataccagagactccatcaggcccaattcggcgagctgatacatgaataatggaaaaaggatagacgagcgggggccgggcagcctcctgtctatccttttttttatgtagtccgtatttaatgggcttctttttgcgcaggttcgatgatatgtttgaaacggtcaacaagctgcaccgctttctttccttccactacaattaaatattcttgttctttatgagccattctgaacgtttccagctcaatgatatctttgattttgcacattgtttttttagagtagatatacagctcgtggcctcccgtgtggcaaagctgataaagctgaagcatgtttcttaaagtgaacttcttagcggctattttcaaagatgtaatgtttttcatgtgttttctcctccgtctgatggtctgttatttcggaaattccccatatgaacgggtgataaacctggttatgccttccacctcagcactccgcccgccaggcgtttaactccgcggatggcgcttaattcttcgacgagccggagcagcgcccggtctttctctttcgcctcaatcataaaatcgatgcccgcatcccattgtctgaaccgctccagcaccggcagaataaaattcgcgtccacatagtccgcatgactgcgtacggctgattctgattttggcgaggagagatggaccttcggctttaagccgatccgctgccatgttttgatcatccgcggaagaatgtcatctaaatcagcgtcatcggccggattggcgtaaaaatggtgataatcaaacacaaacggaatgccttcttgctcacatacactgagtgtttcctcggacgtatatgttttatcatcgttttctaaagtcatccgctgtttgatgacttcgggaagttctttcagattcacgcggaaacggccaagcgcgctttgtttgtcaccgtaagcgcctccgacatggatgttgatgacggaacggtccgcgatgcccattgcgtccagcatgtcataatgataggccatatccttgaccgcatttgcggtaatctcccgtttcgggcttgtaaaaagcgtgaattggttcggatgaaagctcgttctgaggtcatattttctgaccagcccgccgatctcacgaaactcctggcgaaacggcgtgacaaaatcccacagtacatccgggtgcgtggcgagcggcacaattgagcttgagaacctgtacaaagggatgccgtggccgaccacatagtggagggtgcgcagcgtattggtaagatttgctttcgtcacagaaagcagagcgtctttccgctcactgcgggaaagcttggtatagcgcgcatatgttaaggttttggcgggggacgcgtcccaaaggcacatggcgtttgcgacgaatccgaatctgaacagcatatggtttctcctttataaaaagtaagatatggcctttcccagccattctgcaggaagctgtctgacggagcgctgtttcactttttctaatgtgagaagctcggatttttcgatgtcctgctttatggttgaaagcacttcctttgtaaaggcctcatcatgaatgatgacatttacctcttcattccagaacaggctccgtttatcaaaattcggcgtgccgataatgctgatgcggtcatctataatgaaggctttaacatgataaaagccttgataataccgatagatgaggcagccggccttcaggagctcgggataataggtaaaagctgtttcccgaacgagcgggtgatctgatttcatcggaacgatcaagatgactttgacgccttttcggcaggctgaaataagcgcttcctgaagctttttgctcggtacataataaggcgtgccgatgatgatttttttctccgccttacggatgcagttttcataatgcgattcaagcgaaaaaccgtcagatgcatatgtcctatgagagatattcccttcggataatgccggataaaccccgggtgattcgggtgtttttccggtgtttcgtttcaggtcgcttacaaaaagagtctgaagatctgccgtgccttcgccggtcatccgcaggtgataatcctcccagtttccgaacttcgctttttttccgaggtactcttcagcgatattaaagccgcccacatagccgattttgccgtcaatgacggtcactttccggtgattccgtttttgcagcctgaaaaaaagaaagggaaatgccggtttatttagaaaatgaacgtgaacgccggcttttttcatcgtttgaatggaaggctttttcacttggcggctgcccgcccaatcgagcagcagatatacggagacgccggcccgggccttttctttcaataaatcaaacatctcatggctgacttggtcgttcttcataataaaaaacatcatatgaatagaagagacggcttggcggatatcagccgtcatctgctgcacaagctcgctgccgcagtgaatgagtgtgatatcactttttttggggtcaaaaacgggctcatacgcctgttttttgtacgccgcccggccaagcagcatatcaagcagcataagtgcgatcaatatgataaaaatgacaagcaacacaaaaatgaccttcataccgacgctcctttccgaagtatccgtagtgtgccctgagaatgtgaatttaattattgactgaacactcattcattatttatgataaagtaaagatatgacaatgaagaggggaatcagaacaaagggggagacaagatgaacgcatttctcatggtaaacgcgctgctgttttcagctgtaaccgcttacgccgtttatttattcgtttacctgatcagaacgaggatcgcttatattaagctcggccaaagggaagaatttgataaacgcctgaaagaacgtcttcagaagatatgggtgaatgtgttcggacagaaaaaattgctgaaagataaaaagagcggaatcatccacgttctgtttttttacggttttatactcgttcagttcggcgcaattgattttattctgaaagggctgcttcctgaccggcatctgccgttcggcccgctttatccggcatttaccttttttcaggaaatcgtcacgtttctgattttaatcgccgtagtctgggcgttttaccggcgctacattgaaaagctcgtcagattgaaacgcgggtttaaagcggggcttgtcctgctgtttatcggcggactgatggtgacggtgctgctcgggaacgccatgaaccttttatggcacgatcattctctgtcttggacggaaccgatcgcttcctccattgcgtttgtgctcggcggtctttcagcgccggcggccgccgccgtgttttatgtttcatggtggcttcatctgttgtttttgctcagctttttagtgtacgtgccgcaatcaaagcatgcgcacttaattgcgggtccggcgaatgtgttcctcagcaggctggattcaaaaggaaagctggaaaaaatcgattttaccgatgagacgaaagaaagctacggcgtcggaaagattgaagacttccgccgctctcagcttgtcgacctttacgcctgcgtcgaatgcggccgctgtacaaatatgtgtccggcctccggtacgggcaagatgctctcgccgatggacctcattttaaagctcagagaccatttgacggaaaaaggcgctgccgtgacatcaaaatctccgtgggtgcccgcgcccgtttttcagcacacgaaggcgaatcagctcgccgcggcttcctcagggggaggatcgcgtgaagcggcggcagccattgattacaacccgagcttaatcggcgaggtcatcacggaagaggagatttgggcgtgcaccacttgccgcaactgtgaagatcaatgtccggtcatgaatgaacacgttgataaaattatcgatctgcgccgctatcttgtgcttacggaagggaagatggacagcgacgcgcagcgggccatgacaagcattgaaagacagggaaacccgtggggcttaaaccggaaagagcgggagaactggcgggagcaggctgatacagagattccgacagtgaaagaaatgaaaaaacaagacaaagagttcgactatttgttttgggtcggctcaatgggttcctacgacaacaggagccaaaagattgccgtttcatttgcaaagctgctcaatgaagcgggcgtatcctttgcgattctcggcaataaggaaaaaaactcaggcgatacgccgcgccgtttgggcaacgagtttctgttccaagagctggcggaacacaacatcggcgaatttgaaaaacacggaatcaaaaaaatcgtcacaattgatccgcacgcctataatatgttcaaaaatgaataccctgatttcggattccgggccgaagtctatcatcatactgaattattagccgagcttgtgtcacaggggaaactaaaaccgcttcacccggtcaatgaaacgattaccttccatgactcgtgctatttaggaagatacaacgaagtgtatgagccgccgagagcgatcttaaaagccattccgggcgttcaattgaaggaaatggagcgcagccgcgaaaacgggatgtgctgcggcgccgggggagggctcatgtggatggaagaagaaacgggagcgaggatcaacacggcccggactgagcaggcgctttctgtcagtccgacggtcatcagctccggatgtccttactgtctgaccatgctcggtgacgggacgaaagcgaaagaagccgaagacgcgatcggcacttatgatgtcagtgaattgctcgccatgtctgtattcggcgccgaaaaacaagagtctttatagaaagaagcgggccgccggcgcatatgccggcggctttgttttcgcacatcagccgatttatgaaggggcggctctaaaatttcttaaattacgctgtttagggtagcatattctgttttaatttgtttataatgagaggtatggtttatgaacaaaacaatacaaattcgttcttattataggatagaaacagatacatataagtaatagaaagggagtgtccgaccttgagtatcaaacaatattctcaggaacagctgaagcagatggctttagttgaaatcgctcacgaaattttctcagaacataaaaaaccggttccgttccaggagctgctgaatgaaatgatctccttactcggtgttacgaaagaggaactgggcgaccgtatcgcccaattttatacagacctcaacattgacggccgctttattgctctgtcagatcagacatgggggctccgcagctggtatccgtacgatcagctggacgaagaaacacagccgactgtaaaagcgaaaaagaaaaaagcgaaaaaagccgttgaggaagatctcgaccttgatgaattcgaggaagttgatgaagatgacatcgatctcgatgaaatggaagaagatattgaccttgacgcagacagctttgacgacgaagatatcgatgaagaagatgacgacgagcttgagattgaagatgagatgattgaagaagatgaggaagattatgatgatgaggaagaggatcgcaaagactgattttatatcagcaaaacgatcttgactttcattgtcgaactatgtagtatgtattttgggctcttcaaaaagaagagaattcataagagtgctacgctccctttcaagaaattgaaagggagctttcttattttcatctcccaaattcttttacacatcatttgtttttagtgaaatgattttctataaaacggcacattttaaggaatgtagcgcagaccgaagagaggagcaaacgaaatgacgaaatatatttttgtaaccgggggagttgtatcatcactcggaaaaggaattgtggcagcatcacttggccgccttttgaaaaacagaggcatgagcgtcaccatccaaaaatttgacccttatatcaacgttgacccgggaacgatgagcccgtaccagcacggtgaggtattcgttaccgatgacggcgctgagactgaccttgacttagggcattatgagcggttcattgacattaatctgaacagattcagcaacgtgacgacaggtaaaatctattctgccgtattgaaaaaagagcgccgcggggactacctcggcggaacggttcaggtcattccgcacatcacaaatgaactgaaagaccgtgtgtaccgtgcaggcaaagaaacaaacgcagatgtagtcattactgagatcggcggaacagtgggagacatcgaatctcttccgttccttgaagccatccgtcaaatgaaaagcgacatcggccatgaaaacgtgatgtacattcactgtacgcttgttccgtacatcaaagcggcgggcgagctgaaaacaaaaccgacgcagcacagcgtaaaagagctgagaagcctcggtattcagcctaatatcatcgttgtgcgcacggaaatgccgatttctcaagatatgaaagataaaattgcgctcttctgcgatattgacacgaaagcggtcatcgagtgtgaagatgcggacaacctttactccatcccgcttaaccttcaggagcagggactcgataagcttgtctgcgatcatatgaaattagaatgcaaagacccggatatgacggaatggaaagaccttgtcacgaaagtgaaaaacttgtctaaaaccattacaatcagccttgtcggtaaatacgtcgagcttcaggacgcttacatttcagtcgttgaatcactgcgccacgcgggctatgcgtttgacgctgatgtgaagatcaaatggattaacgccgaagaagtgacagaaagcaatattcaagagctgactggcggcacagacggaatcatcgtgcccggcggtttcggggaccgcggcgtagaagggaaaatcatcgccgccaagtatgcgcgtgagaataaaattccgttcttcggcatctgcctcgggatgcagattgcatccattgaatatgcgcgaaacgtattaggtctggaaggggctcactctgcggagatcgatccgtccactccttatccgatcatcgaccttctgccagaacaaaaagatgtcgaggatcttggaggaacgcttcgtctcggactgtacccttgtaagcttcaggaagacacgaaagccttcgaagcgtattcggatgaagtggtatacgaacgccaccgccaccgttatgaattcaacaacgaatacagacagcaaatggaagagaacggttttgtgttctcaggaacaagccctgacggccgtcttgtggaaatcatcgagctgaaagaccatccttggtatgtcgcttgccagttccaccctgagttcaaatcaagaccgacaagacctcagcctttattcaaagactttatcggcgcttccgtacaagctgcagaacagaagtaataaaaaaagacttgcctcctttaaaagcggcaagtcttttttctgcatcaggcatattcctgcatcatttcctttaacgtaaaggacagcgcgtgatagacatacaggcctgtcattaatgaaggaaagccgtatcttgtcccgtcttcatcgggcagaagcggcatttttaatttgctgtcaatatgaacatcacaaaattcctcaatcccggtttgatctttgatgacaggagatacgcaaacgaggccgacccctttttcataaagcttttgagccagcgcctgttcttcagccgtgcccggacctgaacaaaacatcagcaccctgtcgctttctgtaatcgaatcagctgtatccggaaacgctttgacagaaggcatcggttctgagccgagttccgcctcgcacaaaatgccctgcatctcatttgcgccgtataaataaatggtatgaccgctgacggctgcctgcgccagcaggcgcgcgccgtcttctattgcatcggactccttatcctgaatgcgggaaaaaatgcctgcaagctgcgtcgtaaatatctttaacatgagtgaaacctcctttacacatacaagaacagtatacaacaaaagagaaaatgctcagaaaatgtcggaaagtagactattataattaaaggaaatgtgaaaatcaaacagaatacataaacaactgcttccttttgacgaaaatgataatattggggtgtaaaatgatgaatgaaaagattttaatcgtagatgaccaatacggtatacgcatattgctcaatgaagtgttccataaagaagggtaccagacgtttcaggccgccaacggcatacaggcgctggacatcgtaacgaaagaacggcccgatctcgtgcttttagatatgaaaatccccggcatggacggaatcgaaattctcaagcgcatgaagatgatcgacgaatccatccgcgtcattatcatgaccgcttacggagaactcgatatgattaaggaatcaaaagagctcggagcgctgactcattttgcgaaaccttttgacattgatgagatcagagacgcggtgaaaaaatatttacctctaaaatcgaattaataaaattagaaacaattatgtcattgtgttgccgatttgtcgaaaagttggtatcctagagatggagaaaaagcgatctgttgttttacatatgacaggtttttatggtcatgctataggtggaaagcttttttcgagaagaagcaaatcaggctacataaggaggactttcgacatgcctttagtttcaatgacggaaatgttgaatacagctaaagaaaaaggatatgctgttggacaatttaacttaaataaccttgagttcactcaagctattttacaagcagcagaagaggaaaaatccccggttattcttggtgtttcagaaggcgcgggacgctacatgggcggcttcaaaacagtggttgccatggttaaagctcttatggaagaatacaaagtgacagttcctgtcgcgattcacttagaccacggttcaagctttgaatcttgtgcgaaagcgattcatgcaggtttcacttctgtaatgatcgacgcatctcaccatccgtttgaggaaaacgtagcaactacagctaaagtggttgagcttgctcatttccacggcgtttcagttgaagctgagcttggaactgtaggcggacaggaagatgacgtgatcgctgaaggcgtaatctatgctgaccctaaagagtgtcaagaacttgtagagcgcactggcatcgactgccttgcacctgcactgggttctgttcacggcccttacaaaggcgaaccgaacctcggtttcaaagaaatggaagatatcggcaaatcaaccggccttccgttagtacttcacggcggtacaggaattccgactgccgacattaaaaaatcaatctcacttggtacggctaaaatcaacgtaaacactgaaaaccaaatttcttctgcaaaagctgtccgcgaaacattggcagctaagccgaacgaatacgatcctcgtaaatatcttggacctgctcgtgaagcgatcaaagaaacggttatcggcaaaatgcgtgagttcggttcttcaaaccaagcttaatccaatgtaacatccataaaccgcctgacagcattgacaggcggttttatgtcttacctttagaaagcgcaatcatgttttacagttctgaaaatttattactggggaggctttccttatgttatttttcattgatacagcaaacattgacgagattaaagaagcttatgaacttggcgttcttgccggagttacgacaaaccctagtttagtggcgaaagaagctgacgtgtctttccatgacagacttcgtgagattacggaagtcgtgagcggatcagtaagcgcggaagtcatttccctgaatgctgaagaaatgattgaagaaggtaaagaacttgcgaaaatcgcgccgaatattacggtgaaaatcccgatgacgtctgaagggttaaaagccgtaaaagcgctgagcgacctgaacattaaaacaaacgtaacgctcattttcagcgccaaccaggcgcttttggcggcaagagccggggcgacttatgtatctccgttcttaggccgtctggatgacatcggccataacggtcttgaactgatttcagaaataagacagatttttgacattcatgacattgatactcaaatcatcgcagcttccatccgtcatgcgcagcacgtgactgaagccgctttacgcggtgcgcatatcggtacgatgccgctgaaagtcattcaccagctgacgaaacatccgttaacggataaaggcatcgagcaattcttggctgactggaataaataagggggaaaagggcggcaaaccggttgcatccgtttgccgcacccttatgttttcctgtttggcagcgggccttcagtatcaaagtgaagagtgtgtttccccggaatatgaacccggcgggcctctgtgcatcctgtgttaaaaatgccccgcaaagcttcgctattttcttcctgttattttataatgtccttgtattctttctcttcgaattggctacattttggacaagagctttatttgcagagacagaataaaatgccattttatttacgctccgcagctatcttcttatggaaggagactatcatggaaaagttgaatattgccggcggcgatccgttaaacggaaccgtacatatcagcggtgcgaaaaacagcgccgtcgcattgatacccgcaaccattctggcaaattccgaagtaacgatcgaagggcttccggagatctcagatattgaaacgctgcgtgacctgctgaaagaaatcggcggaaacgtccattttgaaaaaggagaaatggtcgttgacccttccccgatgatcagcatgccgcttcccaacggcaaagtgaaaaaactccgcgcttcctattacttaatgggcgcgatgctcggccgcttcaaacaggcggtcatcggactgccgggcggatgccatctcggtccgcggccgattgaccagcatatcaaagggtttgaggcgcttggagcggaagtcaccaatgaacaaggcgcgatttatctgcgcgccgaaaggctgagaggcgcacggatttatttagatgtcgtcagcgtcggagcgacgattaatatcatgcttgccgctgtactggctgaaggtaaaaccgtgatagaaaacgccgccaaggaacctgagattattgatgttgccacattgctcaccagcatgggcgcaaagatcaaaggtgcgggaaccaatgtaatcagaatcgacggcgtaaaagagctgcacggatgcaggcatacgatcattccggacagaattgaggcgggcacctttatgatcgccggcgccgcgatggggaaagaagtcattattgataatgtcataccgactcacctggagtctttaacggcgaagctcagggaaatgggtttttacattgagacgagtgacgatcagcttcttatgctcggcgggcagaagcagataaaaccggtcgacgtgaaaacgcttgtttacccgggattcccgactgatcttcagcagccgatgacatctctgttaacgagagccagcggcacgagcgtcgtaaccgacaccatctactcggcccgatttaaacatattgatgagctgagacggatgggggccaatatgaaagtggaaggcaggtcggccattatcaccggtccggccgagcttcagggcgcaaaagtaaaggcgagcgatctgcgtgcaggcgcttgtctggtcgtcgccgggctcatggctgacggcgtaaccgaaattaccggtcttgagcatttagaccgcggctacagcaatcttgagaaaaaactcgaaggtctgggcgccacaatctggcggcaaaggctgacggacgaagagatagaacagctccaaaattcatagaaatgcggacttttgagaggagatcgtgttgaaatggaaagaagcttatcgatggaattggttcgagtcactgaagcggcggctttagcatctgccagatggatgggccgcgggaaaaaagatgaagctgatgatgcggcgacaagcgcaatgcgtgacgtgtttgacacggtgccgatgaaaggcacggtcgtgatcggggaaggcgagatggatgaagcgccgatgctttacatcggcgaaaagcttggaaacggatacggcccgcgcgtcgatgtcgccgtcgatcctcttgaaggcacaaacatcgtagcgagcggcggctggaatgcgctgacggtgatcgcggtcgccgaccatggaacattgctgaacgccccggatatgtatatggaaaaaatcgcggtcggtcccgaagcggtaggctgcatcgatatcgaagcgcctgtcattgataacttaaaagccgttgcgaaagcgaaaaacaaagacattgaagatgtcgtggcaaccattttaaatcgtgacagacacgaaaaaatcatctctgaattgcgtgaggcgggcgccagaatcaaactgatcaacgacggtgatgtcgcgggcgccatcaatacggcctttgaccatacgggagtagacattctcttcggttcaggcggggctcctgaaggcgtgctgtctgccgttgcgttaaaagcgctcggcggcgaaatcatcggcaggcttctgccgcaaagtgcggaagagcaggcccgctgtgagcgaatgggccttgatgtatccaaagtgctccggatggaggaccttgtgagaggggatgacgccatttttgccgcaacgggtgtcacggacggagagctgctgaaaggcgttcagttcaaaggctccgtcggcacgactgaaagcctggtcatccgggcgaaatcaggaacggtccgattcgttgacggaagacacagcctgaagaaaaaaccaaatcttgtgatccggccataaatagagaaaagcgggacggaaagtcccgcttttcttttgcaaaaaagagtcaaccctatcatttatatgtcaaagcattatttaagttgaataattttttgaaatgaggtaaaaataaagagtgctgcgatttttctgtgtcattccttcttttgagtactgggaaattttcaaattctaccgcatacagacgatataaatattgatcttctcaagtttttgtcctcgcttccttcaaaactcattaagacattccttttttaaaaaagcgccgatcatgggtggaagtgttaccgatagaagttcctgaacgttttataaaagaatgtgctttggcggaatcatgcgaagcagccgatttgaatgaaaacagcaatacattgactatgaaaagcgtggtgtttttatgaaagacgtatctatttcctctttggaaaatatgaaattaaaagaactatatgaactggccagacattataaaatctcctactacagcaaactgactaaaaaagaattaatctttgccatcctgaaagccaacgccgagcaggaggatcttctgtttatggaaggcgtgctcgaaatcatccaatcggaaggattcggcttcctcagaccgattaattactcgccaagctcagaagacatctacatttctgcttcccagatccgccgctttgatttaagaaacggtgacaaagtatccggcaaggtgcgtccgccgaaagaaaacgaacgctattacggacttttgcacgttgaagcggtaaatggagacgatccggaatctgcgaaagagcgcgttcattttcctgcgctgactccgctttatccggaccgccaaatggtgcttgagacgaaaccgaactatctctcaacaagaattctcgatatgatggctcccgtcggtttcggccagcgcggtctgatcgtggcgccgccgaaagccggtaaaaccatgctgttaaaagaaatcgctaacagcattacgacaaatcagcctgacgctgaattgatcgtgctcttaattgatgaaagaccggaagaagtaacggatattgaacgttccgtagcgggcgatgtcgtcagctcgacgttcgatgaagtgccggaaaatcacattaaggtagcggagcttgtgcttgaacgggcgatgcgtctcgttgaacacaaaaaagacgttatcattctgatggacagcattacccgcctggcacgggcctacaacctcgttatcccgccaagcggacgtacgctttccggcgggattgacccggctgcgttccatcgtccgaagcgctttttcggtgccgcgagaaacattgaagagggcggcagcctgaccattttggcgacggcgctcgtagacacgggctcccggatggatgacgtcatctatgaagagtttaaaggaacgggcaacatggagcttcaccttgaccgttctcttgcggaaagacggattttcccggcgatcgatatccgccgctccggcacgcggaaggaagagctgctcgtgccgaaagagcatcttgaccgtctatgggcgatccgcaaatcgatgtctgattctccggacttcgcagagaagtttatgagaaaaatgaaaaaaacaaaaacgaatcaggaattcttcgatctgatcaaccaagaatggaagcaggcaaacctttcatcatcagcccgccgctgataaaaaatgtatttgcaaatgcagtaaatgactgatataattctctcatatgcgttccggattcgctccggaataataactctgtttccacacgggattcagggcggaaggagatggatacaatgaaagcaggaattcatcctaatttcaaaaaagcaacagttaaatgcgcttgcggaaatgaatttgaaacaggctcagtaaaagaagaggtacgcgttgagatttgctctgaatgccacccattctacactggacgtcaaaaattcgcttctgctgatggtcgtgttgatcgctttaacaaaaaatacggtcttaagtaataatagattttacaggcaggcaagaattgcttcttgcctgttttttatgtccataaacaggaaaaaaaggggagcggatagcctatgtacataatgaagcaaagcggatggcttgagctgatatgcggcagcatgttctctgggaaatcagaagagctgatccgcagagtgaaaagagcgacatatgcgaagcaggaggtcaaggtgttcaaacctgccattgataatcgctacagtgaggaggctgtcgtttctcacaacggcacatccatgacaagccacgtcatctcgtcttcggctgaaatatgggatcatatcagtgaaagcacggacgtcatcgcggtagatgaagtgcagtttttcggcgaatcaatcatcggcgatttatccttgcttgcggataaaggctatcgtgtcatcgcggccggacttgatatggatttccggggagagccgttcggtgtggtgccgaatctgatggcggttgccgaatcagtgacgaagctgcaggcggtctgctccgtttgcgggtcgccggcaagccgtacgcagcgtttgattgacgggaagcccgcttcctatgatgatccggtcattttagtcggcgcgtcggagtcatacgaagcgagatgcagacatcaccacgaagtgctgaaaaaacagactgataaataacccttttcatgaaaacatcggtaaaaaatccggtgtttttttgacggtttttcaaaaattgtagttaattaacttaaaaaagagtatgaaaaaattaagtaattttcatctcttgaattttcatttttacaggcataaaatgactaagtaatgtaaatagttatgagacattgttcgaataattgtcaaaaaaagatatagcagatcgcgatcacactagccaaaatgggtaattacttaactttgttaactatttgaagaaagaaggagattttcttgaataatattaaagtaacgaaggaaggcaacttagaaactactttaagaggaaaagaagttctatctatccctactttaaataaaggtgttgcgttttcagcagaagaaagaaaaagccttggattagacgggctgcttcctccgaccattctgtctcttgatgagcaggcaaaacgcgcatacgagcagtttcaagctcagccggaccgccttcgccaaaacgtgtatttgaatgatttgcaaaaccgtaacgaagttcttttctttaaattgcttcaaaaccatcttcgtgaaatgctgccggttgtttacacaccgactgtcggtgaagcgattcaagaatacagccatgagtacagaagacctcaagggatttacctttctatcgacaatgtagaaggaatcgaagaggcatttgaaaaccttcatgccactgccggagatattgatctgatcgttgcgacagactcagaaagcatcctcggaatcggtgactggggtgtaggcggtatcaacatcgccatcggtaaattagccgtatacacagctgctgccggtattgacccaagccgtgttattcctgtcgttcttgacgtcggtacgaacaacgaaaaacttctgaacgatcctttatacatcggtaaccgccatgaacgtatccaaggcgaacgttatgaagctttcattgacgcttatgtaaaagctgcgcttaaatatttccctaaagctcttcttcactgggaagaccttggaaacaaaaacgcgcgcaatatcatgaagaaatacaatcatgaaattcttacattcaacgatgacattcaaggaacaggcgcgattacgcttgcaggtgtgcttgcggctatgaagaaaacaggcgcgtctattaaagaccagcgtgtggttgtcttcggtgcgggatctgccggaatcggaatcgctgaccaaatccgcgacactatggtgcttgccggtctttctgaagaagaagccaacaaagcgttctacacaatggactacagaggcttgttaattgaaggtatggaaaacattcttgatttccaagagccgtacctgcgcacagctgaagaaattaaagattggaaacgcgatgaaaacggacaaattcctttcattgaagtgatccgtcaagcgaaaccgacaatcttaatcggtacatcaggccaaagcggcgcgttcagtgaagaaatcgtcaaagaaatggcaaaacacgttgagcgtccggtcatcatgccgatgtctaacccgacaccgcttgctgaagccgttcctagcgatctattcaaatggactgacggcaaagtgcttgtggcgacaggaagcccgtttgacaatgtagagtacaatggcgtttctcatgaaatcggacaatctaacaacgcattcgcgttccctggacttggtctcggttcaatcgttgtagaagcgaaagtgattactcctgcaatgtttgcggcaactgctgacgcaatcgcagaaagcgttgattttgaaacaccgggtgcaggccttctgccgagcatgagcgacttacaagaagtttcaattaaagttgcgatcgccgtagcggaaactgccattaaagaaggcgtggcaaaccgcattcctgagaatgtagaacaagccgttcttgatgcaatgtggaaaccgcaatataaacaagttatcgctaaataatttttacgattaattttacagtccgagggaaagcttttatgtaaaggctaaagtatacggacattaaggatttggaggagaatattttgagcttcttagatattttaatcctcctggcgccgatctttttcgtgatcgtgctgggatggttcgcaggtcgcttcggaagttatgacgcgaagtcagcaaaaggggtaagcaccttagttacgaagtacgcgcttccggcgcattttatcgcaagtattttaaccacttcaagaagtgcgtttttatcacaggttcctttaatgatcgctttgatcattgggattgtcggattctttatcgtcattttgttggtttgcaaatttatcttcaagtatgatttaacgaattcatctgtattttctttaaactctgcacagccgacatttgcatttatgggtattccggtactcggaagcttattcggagcaaacgaagtagcgattcctatcgccgttacgggtatcgtggttaacgccatccttgacccgcttgcgatcattatcgctacagtcggtgagtcatctaagaaacaagacagcgaaaacgagaacttctggaaaatgactggtaagtctattcttcacggtctttccgaaccgcttgcggctgcaccgcttatcagtatcatcctggtactctgcggtgtaacactccctggcttgggtgaaaaaatgcttgatcagctcggaagcacaacatcaggtgttgcactctttgccgtcggtgtaactgtcggtatccgcaacatcaagctcagtctgccggctttcggtatcgctttgttaaaagttgccgttcagcctgcgctgatgtacttgatcgctcttgcagtcggacttccggctgaccagatcactaaagcggtattgctcgtcgcattccctggatctgcggtagcggcgatgattgccacacgtttcgaaaaacaagaggaagaaactgcgtccgcgttcgtgatcagtgcgattttatctcttatctcactgccgatcatcattgcgctgactgcataatgaaaagctccctgtttcagggagcttttttgattagaattgaaatttaaaaggcgaaaatctcgttttttttctgggtttcttatgttctgaagaagcggctgtttctgagaggggagctgtctgggcaagttcctggatgcgggaggccaatgtctgcaattcggtattgaggtcgtcaatttcccgtctgtgctgaagaagctgataagacaccccttcatccgccttttgtttcagctggcgttcaagctcctctatccttgaaagcagatggttctcatcctgtttctctttcgtgagaatgtccagtttgcgctccagctctgccaacctttgttcagcgccgccattgattttcggacgctgcaaaatgaagcccgtccgttttttcggctgccggggcacttgaacgtccagaagggcagtgccttcagaaatttgccgtttgaccgatttcagcacatcaagatcctcaggtgtaaaggaataatgtccgagctcattccgttcagccggaagattcagctgcttgacccacctttgcaccgtttttgcggagacgccgagctctttcgcggccatgtttgtattcatgatcacatacctcctttttgctaggtattcgaccatgaggcggcgttcccttcatgttagacaaaacaagaaggaattcgccaaagaaagcggcatttcttcaaaaaacgttacgcttcatacaattcaagcggaagcttgtcgggatcgaagaaaaaggtaaaccgtttccccgtcagcggatcggttctgatcggttctgtgccgacgccctttttctttaactccctgacggctgcttcaagatcgtttacggtgaaggcgagatgccggagacccgcggcttccggtctggtcggccgttcgggcggatcgggaaaggaaaacaattcaatcgcatacgcgccgtccagcgccagatcgagtttataagattcccgttcctttcggtatgtttcttttataatgccgaaaccgagtatctcggtgtaaaaagctttcgacttttcataatcagagcatatgattgctatatggtggatggatttcagcatatccgcccctccttttttgcttcagtataacagaggcgaattgcttttgactggtgataagccctatactataatgagaatgttacgcacaggaaaacagaggtgaagaccgtgttagaccgtttacagtcaattgaacaacgatacgaaaaattaaatgagcttttaagtgatccggaagtggtcaacgatccgaaaaagcttagagaatattcgaaagagcaatctgatatacaagaaaccgttgaagtctatagacaatacagagacgcatcagaacagcttgccgatgcgaaagcgatgcttgaggaaaagcttgatgccgatatgagagaaatggtgaaggaagaaatctccgaactgcagggagagacggaaaccttatcagagcgtttgaaagtgctcctcatcccgaaagacccgaacgatgacaaaaacgtaatcatggagatccgcggagcagcgggaggagaagaagccgcgctgtttgcgggaaatctctacagaatgtactcccgttacgctgaaatccaaggctggaagactgaagtcatggaagcaaacgtgaccggaacgggcggttacaaagaaatcatctttatgattacgggaaaaggcgcatactccaagctgaagtatgaaaatggcgcgcaccgcgtacagcgtgtgccggaaacggaatcaggcggccgtattcatacatccacggcgacggtggcgtgtcttcctgaagcggaagaagtagaagtggacatccacgaaaaagacatccgcgtcgatacattcgcatcaagcggaccgggcggacaaagcgtaaatacgacgatgtcggccgtacgcctgacgcatttaccgaccggtgtcgtcgtatcctgtcaggatgaaaaatctcagattaaaaataaagaaaaagcgatgaaggtgctccgcgccagaatctatgacaaattccagcaggaagctcaggctgaatatgatcagacccgtaaatcagccgtcggatcaggcgaccgttccgagcgtatccgcacatacaatttcccgcaaaaccgtgtgacggatcaccgtatcggcctgacgattcaaaagctggatcaaatcctggaaggcaagcttgatgaagtggttgaagcgttaatcgtagaagaccagtcaagcaagctccagcaggcggaaaattaagatgaagaccgtttttgaagccctaagctgggcttcttcttatttaaccgaagcgggaagagaaaaaaacgcggccgagctgctgctgttaaatgataccggaatggatcggagcaagcttctcgcaagtctgcaggagcccgtcggcgaggacgagctttaccgattcagacggcatgtggaaatgcataaagaaggcgttccgattcaatatattatcgggaaagaacagttttacggcagagaattctttgtgaatgacgatgttctcattccgcgtccggaaacggaagaagtcgtctttcatctgctggacagacagaagcgggtgttttctgagggagaacgcctgaacgtcattgatatcggtacggggagcggagccattgcggtgacgctcgcgcttgaatgcggacatttttcagtatcggcttcggacatttcaaaagaagcgcttcaggtggcggaaagaaatgcgcaaaacctcggagcggacgtccgctttttgcagggagatctgttaactccttttatttcatcaggaataaaagcggatattattgtttccaatccgccgtatatttctgaagaagaaatggcggatttgtcggatatcgtccgtttccatgagccgcttcatgcacttacggacggcggtgacggtttgaaattctacaagcggtttatggaggagctgcctcttgtcatgaaagataaagcgcttgtcgtctttgaaatcggatataatcagggaaaagccgtgaaagacctgttccgtcattcctttccgaatgcggaagtggaagtcgtacaggacatcaacggaaaagacagaaccgtatccgcggtcatcacatcatgaaaaaagcccgccggtgacgcacacggcgggcttttgttacaatggaaagaaaatgaaaggggcatccgccttgaaaaaagcgttcgccttcggatgtatactcgccgccgcagcttatgcggctggatttgtcctgccgtttggctttgacatcattctcggcgccgttacggctgttcttatcgtcgcagcggtcatcgtttccgggctggccgtaagcggagcggagcagcgggccaattatcattctgaaacagaagaaggacggcgcgcccgtttaaagatggccgccgttttcttttgcgccgctctcccttcagccggctgtctgctgattacgcttctgtagccggattttgtctttgcagcaatacggaatcccatacccaatagacgacggctgttaaaaccgcaaagatataaaaggctgaattagaaaacagagattggcctgacggctgcaaaagaccgaagatgatcccgtttgcaatgaacgacacccccaaataataaagaaaatacagcggatgaaatctcttcggctttttattcagaaagtattgaagcggcagcgcaaaaatcaaataaggaaacaaaaaataaaacgccatcgaaatgaaagccgcgataatgaattgatgaacatacaaaatagaataaatgacagacatacatgccgccgacagcagcacggtgtaattatatttcatctgaaaacctcctatcaaaataatatcgtaccatattttgaatctgtcaatgcagattatcagcttgctagatttttttcttcccgccggtttaaaccttttccgtcatgtccataatgggactagataaaaaaagcacggagaggaacggtggggaccgatgaaacagacaatgatgatctgcatatatatttttcttttattatcaggagcgcttgcgggtttgacaaaagaagaaacggcgcgggcatcagccgatgagcccgtcgtcataccggatgaagcgatccggctcaggattttggccaacagtgataacgatgaggatcaaaagctcaagcgccagatcagagatgctgtaaacaagcaaatcacggactgggtgaaagatatcacttccattgaagaagcgcggcggctcattcgttcgaagcttcctgaaattaaagaaatcgccaaacaaacgatgaaagaaaagggtgcgcatcaatccgtttcagttcaattcaataaaatctcgtttccgacaaagctgtacggcaatatggtctatccggccggaaaatatgaagccattttaattacactcggcaatggcgagggcgccaactggtggtgcgtcttgtttccgccgctgtgcttccttgatttctcaaacggcgaagcggtgaaagatcaggaagacggcggacagaagcaggaagaaacgcagaaacagacagaaaaagtgctggatgacgtaaaagcaaaggccgataaagcgaagaaagaaaataaagatgacgatgataccgaagtgaagtttttcctcgtcgattggatttcagatctattttcctgaagcaaaaggcataaatccggattcgattcatagattggaagaaagagttgatcgaaacggagggaaatatatgttttatcagctgagagtggcaagagatcaagatacggaggcgctggaggcctttttgaaaaagtctgatacggcacatgcggaaatcgatcagcagatcagccggtttatcgtgctggaagacagcgaaaaaaagattgccgcctgtctcgggatcgaaaaattcagcggcggaaaagggcttctccgttcactcgtcatgtcggacaggctgaatcaaagccatatcgttacactgtttcaaagtatggatgtgctgtgcaaaaaacatgaaattcaagatgtctacttagtcgccaatcagccctcatctgctgagtttctgaatgtgatgggatttgaagcgtgcgccgatgcgcctgaggaactgtatacgtccgaacatttccgcaactcgttatgcacagaaggttcgtttttaatggtgaaaacctctgcctgatctaacttatacacaaggttatccacttattaaaaagtgttgtccacagtttgtggataacgcttgttttattaaaggacatcttttatactttcaaaaggaatacacgagagaaaataaagttttaccgctttaaaataaggagtttggttatacatgaaaacaagaagatggtttgtggattgttccgcagaattatccacaaccgatccccaaattacacaagccgcggaattgctccggcagaatgaggttgtggcttttccgacagaaaccgtttacggactgggcgctaacgctgaaaatacggaagccgtaacgaaaatatatgaggcgaaaggaaggccgagcgataacccgctgattgtgcatatatcccatatcagccagcttgatcgttttatcagccatattcctgagacggcgaaaaagcttatggagctattctggccggggcgctgacccttgtcctgccgtgtaagcccggtgtgctgtcaccccgtgtcaccgcgggactggagacggtagcggtcagaatgcctgatcatccggcagcattagccctcatcagctcggccggactgccgatcgccgcgccgagcgccaatttatcaggaaaaccgagcccgacgaaggccgagcatgtagctcatgatttaaacggccgtattgccggtattgtggacggcggcgcgacgggaatcggagtggaatcaaccgttctgtcctgtacggggaaacagcccgtgctgcttcgtccgggcggcgtgacaaaagagcagattgaatccgccgccggtccggttcttgtggataaaggactgaccgaagaagatgaggttcctatttctcccggtatgaaatatacacattacgcgccttctgcgccgatggctattgccgacggcggcgcccggagaattcaagaactggcagacgcatataaaagccggggaaaacgaatcggcattttgacaacagaagagaacgccgatagttaccaggctgattatatcaaggtctgcggcagacgcgccgaccttgaaacagtggcgtccgccttatacgatgcgctccgcagctttgatgaagcggaagtggatatgattatttctgagtcctttccggataccggagtggggctcgccgttatgaacaggctgatgaaagccgcaggcggcaccgttatccattaacttgttctaccccttatcggacatgcataagctaaacaagcgggcacgtccaaggggtttttattcatgtcgaatctattcatcggggaacttgtctccttaagcatcatggcatttgctttggggacggatgccttttccgtcgggctcggaatgggaatgattcagctgaagaaaaaacagatttttcatataggggttgtcatcgggctgtttcatgtcatgatgccgcttgtaggaatggcggccgggcatctgctgtccggttttctggggatgctcgccgtttacatcggcggatctcttcttttcattttaggggtgcagatgatgatcgccgcgtttaaacaatcggacgggccgctcatatctccggcaggctcgggactgttgctgtttgcggtcggtgtcagtctggacagcttttctgtcgggctcagtctcgggatgaacggctccaatccgtttctggccgttacgctgttcggggtcttcagcaccgttttaacatgggcgggccttttggcgggaagaaaggtgcagtcatggctcggctcctacagcgaagcgcttggcggagccattttgatcggattcgggctgaaactgcttttaccgatataagatacgtaaaaaaagaaacgaagatgccgtttcttttttcttcatttataataggtagtaagaggtgacggacatgaaaataatctttgtttgtacaggcaatacgtgccgcagtcccatggctgaggctctttttaaatccatagcagaaacgaaagggctggatgtcagcgtaagctcggccggcgtattcgcgtctccgcacggaaaagcgtcggctcatgccgtagaagcgctgtttgaaaaacggatcgccctcaatcacagttcatctcccttatcggaagaacatatcgagacggccgatctggtgctggcgatgaccgaacagcataaacagctgattgaaggccgatatcaaaacagtcagggcaaagtttttaccattaaagaatacgtgacgggggaaagcggcgatatctctgacccgttcggcggtccgcttgatgtttataaacagacgcgggacgaactggaggagctgctgacccttttggctgatcaattgcttgacgggaaaagcaagtaatctgtcagaaaatctgcaaacaggtcatttgcaaaacgaatgtgaaagagtagaatgaaatcaacggatttcgtaataaaaaggacaagcacactgggctgtcttcgcccagccacacctaggaggtaaatgaatgaaagtagctattgcgtcagatcacggcggcgtccatatccgcgaagaaataaaaagtcttttggatgaattgcagattgaatacattgatatgggctgtgaatgcggcgccggctctgtcgattattcagactacgcttttccggtagcggaaaaagtggtgaacggcgaagctgacaggggaattttaatttgcggcacaggcatcggcatgagcatctccgcaaataaggtaaagggcatacgctgtgcgcttgcccatgacaccttcagcgcaaaagcgacgcgtgaacacaatgacacgaatgttcttgcgatgggcgaacgcgtcatcggcccggggctggcgcgcgaaatcgcaaaagtctggctgacgactgaatttacgggcggccgccacgaacggcggatcggcaaaatcgcagattacgaagaaaaaaatctgtaagaggtgctggacaatggaagagatgaagcaaaaatggacggacatgctgactgagtttcaagagcaggcaggactgacggacggcagtctgctggtggtcgggtgcagtacaagtgaagccgccggaagccggatcggcaccgccggaagcggggattgggctgaattgatatacggcggacttaaccggtttaaggaaaaaacgggtgtgcatcttgcttttcaatgctgcgagcatttaaacagggcgcttgtcattgaagcggaaacggccgagcggttcaggctccccattgtttcagccgtccccgtcccgaaagcgggcggagcgatggcctcttatgcataccggcagatgcgttctccagtgctcgctgaatcgattcaggctgacgccgggattgacatcggtgatacgttcatcggcatgcatctgaaacccgttgccgtccctgtccggatatcgagccgtgagcttggagaagcacatgtgacgatggcccggacaagaccgaagctgataggcggaattcgcgccgtatatgaatgcgaatgatgaaaatacttttcctctataatgttcgtgttttctaattaaattttgtgatttttttaaataagctgttacattcacctgaaaaaccatgtacaataaggtggtaaaaataaagaacaggaaacggataggagaggatctcgctgatgaaacatttacctgtacaagataaacaagtgtttaacgccatcaaagatgagcgtaagcgtcaacagactaagatcgaattaattgcttctgaaaacttcgtgacggaagcggtaatggaagcacaaggctctgttttaacaaacaaatatgctgaaggctaccccggcaaacgctactacggcggctgtgagcatgttgatgtcgttgaggacatcgcccgcgaccgcgcgaaagagattttcggagctgagcatgtaaacgttcagccgcactcaggcgctcaggcgaacatggctgtttacttcacgattttagagcacggcgacacggtgctcgggatgaacctctcccacggcggccacttaacacacggaagcccggttaatttcagcggcgttcaatacaactttgtagaatacggtgtcgataaagacacgcaatatatagattatgaagatgtgcgtgaaaaagcgctggcgcataagccgaaactcatcgttgccggagcgagcgcatacccccgcacgatcgactttaaaaaattccgtgaaatcgctgatgaagtcggcgcttacttcatggtagacatggcgcatatcgcgggtcttgtcgcagccggccttcatccgaatccggttccttacgctgactttgtaacgacaacgactcacaaaacacttcgcggaccccgcggaggaatgatcctttgccgtgaagagttcggcaagaagattgataaatccattttcccgggaatccaaggcggaccgcttatgcatgtcatcgcggcaaaagccgtttctttcggagaagtgcttgaagatgatttcaaaacatatgcgcaaaacgtcatctcgaacgcgaagcgcctggctgagtctctgaacaaagagggtattcagctcgtatcaggcggaacggataaccaccttgtgcttgtcgacctccgttctctcggactgaccggaaaagtcgctgaacacgttcttgatgaaatcggcattacatctaataaaaacgcgatcccttacgatccggaaaaaccgttcgtcacaagcggaatccgtctcggtacggcggctgtgacaagccgcggctttgacggtgacgcgcttgaagaagtcggcgccatcatcggcctcgcgctgaaaaatcatgaagacgaagcaaaacttgaagaagcgaaacagcgcgtatctgccttgactgaaaagtttcctttatataaagaactggactattaataaggaagaaacccgccggaaccttaatccggcgggtttttttatgattttcttgaaactgtttgtctttttctgtagaatcaatagaagtgtgaaaaagtcactcggacaacaaaaaaggagctgaacacagtatgggaaaggtttacgtatttgatcatcctttaatccagcataagctgacatatattcggaatgaaaatacaggcacaaaggatttcagagaccttgtggatgaagtcgcatcactgatggcgtttgaaattacacgtgatcttcctcttaaagaagtggaagtgaaaacacctgttcaaacagcgacatccaaagtgatttcagggaagaaactcggtatcgtgccgatcctgagagcgggtctcggaatggttgacggcatgctgaaattaatcccggccgctaaagtgggacatgtcggattataccgtgatccggaaaccttaaaaccggtggaatactatgtcaagcttccttctgatgtagaagaacgcgaatttattgtcgtggatccgatgcttgctacgggaggctctgcggtggaagcgatcaacagcctgaaaaagcgcggcgcgagaaacattcgttttatgtgtcttgtagcggctccggaaggcgtggaagagctgcagaaacatcattctgacgttgatatttatatcgccgcccttgatgaaaaactgaatgaaaaaggctatatcgttccgggcctcggtgacgcgggtgacagactgtacggaaccaaataaatcggaaaacctcattcaggggttttcttttttttatccagattttagctgaatgggcagaggtcatacatttataggtgaatttgtgaacattctgtgtatgcttccggtataaaaagttttttaactttaaacagattgacacatgttaggggctattgtatgctaaacgagggtattatgagaaggttttcattcctttcatttctagtatccatcctcattttaaatcctccaaaaaaacccgttatatgaggatttatctaagcgaatgaaacagcatcccgtagcatcaggaggatgagtggttttttcgaacaggccgttttgcggacaaaaaaggccttctgcaagggttaaccgcatgttttgccgtatccaggaattatattacattttcatcaggagacagatagttgatggacgatcccaatcttacattcagcagacaacggagatatgtatttgtaatcttagcaatctatttgctgggatatggtcttacggcgtataaaactgtttttttaggcctctttttgggaactgttttcagtttgtttaatttgtggctcttgaccagaagaatgaatgcttttgacaaggccgtggcgaaaggaaagtccatacgatcactcgggagcgcagcgcgttggtgcaatgcgatacttgcgatggctgtcgcctttaaatatcccgataaagtcagtgtggcaagtgtgattattggattaatgacaatttatcccgtcattatgatagattccattattcagctcaaacgttcatcaatggaagagaggtgaaaacccattgaatcacgattacagaactattgatttgtttggtcttacttttaatctgacaaacattctgatgattactgtggcaagtgtgattgtgctgctgattgcgattcttactacaagaacgctgtccatccgtccgggaaaagcccagaacttcatggaatggattgttgattttgtccgcaatattataggcagtacaatggatttaaaaacaggggctaacttcttggcgcttggtgtaaccttgctgatgtacatatttgtatcaaatatgctagggctgccgttttctgtaacggtcggacacgagctttggtggaaatcaccgacggctgatccggctattactctgactctagccgttatggttgtgtcgttaacgcactattacggcgtgaagatgaaaggtttgaaggaatactctaaggattacctcagaccggttccgcttatgttcccgatgaagatcattgaggagtttgcgaatacgctgacactcggacttcgtctttacggtaacattttcgccggggaaattcttcttggcctgcttgcgaatctggcgacgaatttctactcaaacagtttctttctcggtttggtcggcacagtcggagccattattccgatgcttgcatggcaggcattcagcttgttcatcggtaccatccaggcatttatctttacgatgctgacgatggtgtacatgtcacacaaaatcagtcatgatcattaaaatcatatatccattcggataacattttaaaggaggaactttttcatgaatttaatagcagctgcaattgcaatcggtttaggtgcacttggtgcaggtattggtaacggtctgatcgtttcacgtacggtagagggaatcgcccgtcagccggaagcaggaaaagaacttagaactcttatgttcatgggtatcgcattggttgaggcccttccgattatcgctgtcgttatcgcgttcttagcgttctttggctaagcaaaaaagccttatatgaactaaaaatggcgaagatcactctaagagaaccttcgccattgctttatgtctgataagcaggccgtcccgaaacggctttttatcagcagagaaaacctgcagaagggagttgccgtagtagatgtctcaattacctcttgaattaggactgtcgtttaacggcggagatatcctattccaattgttagctatgttagttttattagcgcttctcaagaaattcgctctgggaccgctattaaatataatgaaacagcgtgaagatcatatcgccggcgaaattacgtccgctgaagaaagaaataaagaagcgcagaagctgattgaagagcagcgcgttcttttaaaagaagcgaaacaggaatcacaatcactcattgaaaatgcgaaaaaactgggtgaaaagcagaaggaagacattatccaggctgcacgcgccgagtctgaaagattgaaagaagcggcgagaaccgaaattgtcaaagaaaaagaacaagcggtttccgcacttcgcgagcaagtcgcatcactttctgtcttaatcgcatcgaaagtgattgaaaaagagcttgatgaacaagcccaggaacaactgattcaggactatcttaaagaggtaggagaaagccgatgagtggatctgctgtctctaaacgatacgcgtcagcgcttttcgacattgccgttgagacttctcaaatcaatgaaatcgaagaagagcttaccgtactaaaagaagtgttccgaaacgaagccggattacaggaagtgctaagccatccgaaggtatcggccgctaagaaaaaagagctgattcagcaatcgttcggcgcactgtctgagtctgtgctgcatacgatttttcttctgattgaccgccgccggtcttcgattgtgcctgatctcacagacgagtttatcaaacttgccaatcaggcccgtcagacagaggacgcggttgtttattcagtaaagccgctttcagaagcggaaatgttatcattgtctcaagtgtttgcaaaaaaagccggaatcgcttcgctcagaatcagaaatgaagtgcagacggatttaataggcggcattaaagtccgcattggaaaccggatttatgacggaagcgtaagcggaaagcttgagcgcatggaacgtcaacttgccggaggaaatcgatagaaggggtgaaacctaagtgagcatcaaagctgaagagattagcacgctgataaagcagcaaattcaaaattaccaatctgaaattgaagttcatgacgtaggtacagtcatccaagtcggagacggtattgcgcgtgtacacggccttgacaattgtatggccggtgaacttgttgagttttcaaacggcgttttgggtatggctcaaaaccttgaagaatccaacgtaggtatcgttatcttaggaccttacagagatatccgcgaaggtgatgaggtcaaaagaacgggccgcatcatggaagttcctgtaggtgaagaattaatcggacgtatcgtcaacccgctcggacagccggtagacggactgggtccgattctgacaagcaaaacacgtccgatcgaaagccaggctccaggcgtaatggaccgtaaatcggtacatgagccgctgcaaacgggtatcaaagcgatcgacgcgttaattccgatcggccgcggacagcgtgaactgattatcggggatcgtcagacaggtaaaacatctgttgcgattgatacaatcttaaaccaaaaagatcaagacatgatctgtgtgtacgtagcgatcggccaaaaagaatctacagtacgcggcgtggtggaaacacttcgtaagcacggcgcgcttgattacacgattgtcgtgacggcatccgcttcacagccggctccgcttctttaccttgcaccgtatgcaggggtgacaatgggtgaagaattcatgtacaacggcaagcacgttctcgtcgtatatgatgatttatccaaacaagcggccgcttaccgtgagctgtcattgcttcttcgccgtccgccgggccgtgaagcattccctggggatgtattctatcttcactcccgtctgcttgagcgcgcagccaagctgagtgacgctaaaggcgcaggatcaattacggcgctgccgttcgtcgaaacacaagcaggagatatctccgcttatatcccgacaaacgtcatttccattactgacggacagattttccttcaatccgatctattcttctcaggcgtgcgtcctgcgatcaatgccggattatccgtatcccgtgtcggcgggtcagcccaaatcaaagcgatgaaaaaggtagctggaacattgcgtcttgaccttgcttcataccgtgaacttgaagcattcgcccaattcggatctgatcttgaccaggcgactcaggcgaaattgaaccgcggtgcgcgtacagttgaagtgctgaagcaagacttgaataagccgcttccggttgaaaaacaggtagccattctttatgcgctgacaaaaggatatcttgatgatattccggttgcggatatcagacgttttgaagaagagtactacatgtaccttgatcaaaaccataaagatctgcttgacggcattgcgaaaacaggaaaccttcctgctgatgaagacttcaaagctgcaatcgaaggcttcaaacgcacatttgcaccaagcaactaacccttagaagatgagagaaaaaggttctctttttctctctttttacgcaaatgaagaataaaggtggtgaaatctttggcctcattacgcgatattaagtcaaggatcacgtcaacgaaaaaaacaagccagattacaaaagccatgcagatggtatccgctgcgaagctgaaccgtgcggaaaccaacgcgaagtcatttgctccgtatatggataagatccaggaggttgtgtttaacgtcggaaaaggcgcgaaaaacgcgaaacacccgatgcttgtctcaagagaagtgaaaaagacggcgtatctcgtcattacgtctgaccgcgggcttgcgggtgcgtttaacagttcggttttgcgaaacgcttaccgcaccattcaagaacgccatcagtctaaagatgaatacacggtgattgcaatcggcagagtcggccgcgatttcttcaaaaaacgggagatgccgattttgtctgagttagtggggcttggcgacgaggtcacttttgctcagattaaagatttgacccgtcagacggttcaaatgtttatcgacggcgcttttgatgaactgcatttggtgtataaccatttcgtcagtgcgatttcacaggaagtgacggagaaaaaagtgctgcctttaacggatttcggaacgagcggcgggaagcgcacggcttcttacgagttcgaaccggatgaagaagaggtgctcgaagtgctgcttcctcaatatgcggaaagcttaatttacggcgcgcttcttgacagtaaagcaagtgaacacgctgcgagaatgacagcaatgaaaaatgcgactgataatgcgaaagaactcattgattcactttcgctttcatataaccgcgcgcgtcaagcggcgattacacaagaaattaccgaaattgtcggcggtgcagccgctttagaatagaaagattttgtcaggagggatagcgatgaagaaaggacgcgtaagtcaggtgcttggaccggttgtcgacgtacgtttcgaggacggccacttgcctgcgatttataatgcgattaaagtttcacagccagctacaggcgaaaatgaagtaggcatcgacctaacgctagaggttgctcttcatttaggcgatgatacagtccgtacaattgccatggcatctacggacggaattcagcgcggaatggaagccgttgatacaggtgcgccgatttccgttccagtcggtgatgtgactctcggacgcgtatttaacgtactgggagataaaattgatttaaatgaaccgctgcctgcggatgctcaaaaggacccgatccacagatcagctccttcattcgatgagctttcaactgaggttgaaattcttgaaacggggattaaggttgttgacctgctcgctccttacatcaagggcggtaaaatcggattgttcggcggcgccggcgtaggtaaaaccgtattaatccaggaattaatcaacaacatcgcgcaagagcacggcggtatttccgtattcgccggtgtaggagagcgtactcgtgaagggaacgaccttttctacgaaatgagcgattcaggcgttatcaagaaaacagccatggtcttcggacagatgaacgagccgccgggcgcacgtatgcgtgtagcactgacgggtcttacaatggctgagcatttccgtgataaacaaggacaggacgtactgttctttatcgataacattttccgtttcacacaagcgggttcagaggtttccgcgcttctcggccgtatgccttctgcggttggttatcagccgacgcttgcgacagaaatgggtcagcttcaagagcgtattacgtctacaaacgttggttcagttacatctatccaggcgatctacgtgcctgccgatgactacactgacccggctccggcgacaacgttcgctcacttggatgcaacgactaaccttgagcgtaaattaactgaaatgggtatctaccctgcggttgatccgctggcttccacttcccgcgcgcttgctccggaaattgtcggagaagagcattatgcggtggcgcgtgaagttcagtcaacgcttcagcgttacaaagaacttcaggatattatcgcgattctcggtatggacgaattaggtgaagaagacaagcttgtcgttcaccgcgcacgccgtatccagttcttcctttctcaaaacttccacgtagctgagcagtttacgggacaaaagggttcttacgtgcctgttaaagaaacggtacgaggctttaaagaaatcctttccggtaaatatgaccatcttccggaagatgcattccgtcttgtgggacgcattgaagaagtcattgagaatgcaaaagagatgggtgtagaagtttaatctggtcctaggagggtaaaagcatgaagaccgttaaagtcaatatcgttactcccgacggcccagtatatgatgctgatattgaaatggtgagtgtaagagccgagagcggtgatctcggtatcctgcctggccatattccgaccgtggctccgcttaaaatcggcgctgtccgccttaaaaaagacgggcagaccgaattggcggctgtcagcggcggatttttagaagtccgtcctgatcaggtcactatccttgcacaagccgctgaaacagcggaaagcattgataaagagcgcgcccttgctgcgaaaaagcgggcggaagaccgtttgaacaaacgatcagatgatactgacattcgtcgggctgagcttgcgttacagcgggctgtaaacagattggatgttgcaggaaactaaaaaagaatccttctcggctgtctgagaaggattctttttctatattaacgcataagagattcatagacgccgataagcggatgatcctcttctttttgcagatataaatgttcgcagcagttgtcggtgtgccacgttttgtttcctctccgcacacccgtcgtataagcgccgtccgtatacggataaggtttgacgacccattcggcatcgtcatgatgtctgatggcgcaatcgatgacatacacactgagcattttctcaaattcgtcaatcggcaggttccaatccgccaaaagcagctcttttatgctgcggaagtaaagagcttccactgccagcaggctgccgggtgaataatcaagagaaatgttgaaaaactgacataattctttcagttcctctgtttgagactgtctataatcatagtagaatgctatcgcttcccactcgtggtcaaatacgggaagtgtttctccatactgcttttccggatgaaaaaaggaatgattcatattcccatctcctttccaaaaaagtatatcatgccggagaacggacatttaagcggggattgcccctaattttggataaaaattctgatgtaaaaatgatcatctttctctcttcttcttatataataagagaggatatgaggggcggaaaaaatgaaaggagatggaatttgtgaatgtattggggcagcaggccgcaatcagcatcctggttcacctggtatgcattgcggtgacatggtgggcgcttcaggccgtcaactttgatccgctgatccgaaaaggaaaaatagtgcaggcgaggctgctgatcattcttcttaccattgcgatcggtacggcagtcgccaacttctttttagattatcttacctattcgaaacagcttccatacttattttaagatgtttcgtctgttgaaatgaagggaatcgctgggtgagaaaccaatttttcttcacccgcttggcgagttttgacgaagttttccatgtattgctttccccggctccggcaaaaatgggagtaagggggagagatcgatatgaagaaaaaaagagcaggccgtatcatcttgttttttgtttttttaagcgccttaatagcggtatttcattccattcatgcaagtgagctgtctccgcttgcccagattgccgaaggaatggagcggcagcaggtcactgtggatgaatggacgcttcatgcgaaaaaaaatctgaacctgtcactgagtgaatttgatgacaaggtaaaagaactgaagacgcagtatccgcaatatcattgggaatccgcgcgggaagataaaatcgtaaaggccgtcggcacgtattctgacaaaaaaaatcacacaacttttaaactgcagctcgtcactaccctcaaaaaccagaacccaacttcgtatttattatatgagcaaatgagcccggagcaaccggaaaactggaatgatacatatgaacagtttgaacggcaggcacatgacatatttcaaaataaagtatttatttttacttgtctaaagggtcatttaaatgataatatgagtattgttttgcaaaaaaaagcagaacagctcatgaaagaatttgaagcaagtccagttgaacatgtagttgagcctcatttcgtttctgtttctgcatttacatataagtggacagattacatcatgacatcgaaacataagatgaatgtgcaagttgcgcttagaagtgcgggaatgggcggaaaacataccgttacggttggcacaccaatcgtgacaactgaatattaatatagagaatatagggacgcggaggggaataccttggaaaaaatcatcgtccgcggcggtcagaagttaaacggcacagtgaaagttgaaggagcaaaaaatgccgttttaccagttatcgctgcatctttattagcaagtgaagaaaaaagcgtaatatgtgatgtacctacgctctccgatgtatatacaattaatgaagtgttgcgtcatttaggagcagatgtgcattttgagaataatgaagttaccgtaaacgcttcttacgctttagaaacagaagcaccttttgaatatgtgcgcaaaatgcgcgcgtcagtgcttgttatgggccctctgttagctcgtacgggtcattcaagagtagcgcttccgggcggttgcgcaatcggctcaagaccgattgatcagcatttaaaaggctttgaagcaatgggtgcaaaaatcaaagtaggcaacggctttattgaagcagaagtggaaggccgtctgcagggcgcaaaaatctatttagatttcccaagtgtgggtgcgacagaaaacttgattatggcagctgctttagctgaaggaacaacaacgcttgaaaacgtggcaaaagagcctgaaatcgttgacttagcgaactatatcaatgcgatgggcggaaaaatccgcggagccggcacaggcaccattaaaattgaaggtgtcgagaagcttcgcggcgtaagacacaacatcattcctgaccgtattgaagcgggtactttcatggtggctgcggctatcacggaaggaaatgtattagtcaaaggtgcggttcctgagcatcttacgtctttaattgcgaaaatggaagaaatgggagtcaaaattacggatgaaggagaaggccttcgtgtcatcggtcctgcccagctgaagccgatcgacattaaaacgatgcctcacccaggattcccgactgatatgcagtcgcaaatgatggcgctgcttctccgtgcgagcggaacaagcatgattactgaaactgtgtttgaaaaccgttttatgcatgctgaagaattccgccggatgaatggcgacattaaaattgaaggacgttctgtgatcattaacggtcctgtacagctgcaaggcgcagaagttgccgctacggacctgcgtgcgggcgcggcgctgattcttgcgggattagtggctgaaggtcatacacgcgtcacggaactgaagcacttggatcgcggttatgtgaatttccataaaaaacttgcggctctcggcgctgacatcgagcgtgtcgttgatgaaacggccgctgaacaagaaagcaaagaagtcgtaactgacctaaacgcataatggctgtaaaaacagtatgtcaatctggcatactgtttttttatggtttatcatcattattatgctctgattttcaaaaaagaatacgtttttcgcgtgaaaaatggaataagattctgtccaaaaggaagtcatattagcttgtccctgcccataagatgaagtagagtcgaatcccaagcaggaggcagctgatatatgaaaccgattgtatttctactatccgggctgtgtatacttattcttcttgttcccaccattctcgttcttccgtttcaggcggaaaaaggagcagccgtaaacagagagcccggacacaaaacaacacacaccacacgagaaacaaaaggagcagaaacattgaaagaatcacctgtatccattccggtttatcggacatccaatcattctgtagagaacattccgcttgaagagtacgtgatcggtgtcgtggcttccgaaatgcccgcaacctttaaaccggaagccttaaaagcccaggcgctcgccgcccggacattcatcgtcagattgatggttgctgactcagccgttcaggcgccgaaaggatcactggtggacgatacgcaaatgttccaagtctatcaaagcaaaagccagctgaaaaaagaatggggttctaagtacgcacacaacctcaagaaaatcacaaacgcggtcgcaggcacgcaaggaaagattttaacgtacgacaacaagccgattgaggcatctttcttctctacgagcaacgggtatacggaaaatgcggaagcctattggacaagcgccattccttatttaaagagcgtgaaaagtccgtgggataagcaatcgccgaaatatcttgccacccagaccttcagtgtgccggagtttcagcaaaagctcggcgtacagctctcgggacaaaacacggtagggcagattacagccagaacgccgggccatcaagtggcgacggccgtcataaacggcaaaaagctgaagggaagagacatccgggaaaaactcggactccgttctgccgactttgaatggaaacggaacggcggcagcatcaccattacgacaaaaggattcggccacggcgtcggcatgagccagtacggggccaattacatggcggagcaggggaaatccgtggcggacatcgtcaagcattattatcagggagtggacatatccgaagcagattcatttttaaacaaatatatggcgaaaaaataggcgctttcatgagcgtctgttttttttgaaaactattccataaacggtaaagcaaccaacagactcatataacgaaagcctaaaggctgacaaatgccgtctgaaggctgagcgccgggtgaaaatcactgataaaaatgccgtatctatgtgaatatacgcaaaaataatgaggaacgccgtcctatttatttcccttttcatctcatttacgataaatattgttcggcgttgaacgtaaatctattgaaaaggggaagaagcaatgaaaaaaacactttcactcataatcatgctcggattgatgctgactgctgcatctcctgcttttgctgccgagaatgcaaacgagaagacatttttatttaaaaacaatatcgccattctgcttgatgcgagcggcagtatggcgaaacggattgacggcgtttctaaatacaatatggcaaaagatgaaatcgtccgttttgcagatcgaattaagtctacatcacaggtcagaatgacggttttcggttcggaaggcaataataaaaactccggaaaagttcaatcttgtgaatccattcgcggtgtatacggattccaaaagtttgacagacagagcttcctcaactctctgaacggaatcgggcctacgggctggacaccgattgcaaaagcattagaagatgcgaaggcttcttttaacggcgttcataaattcggctttaaatccgtttacctgttgacggacggtgaggagacatgcggcggagatcctattaagacagcgaaagaacttcgcaaacatcatattaaagtcaacgtgatcggctttgactttaaagaaggcttcaacggacagcttcacgcaattgccggtgcgggcggaggaaaatattacgaagctcacagccaaaaggatatgaaccgcatctttacgatggaagcgagttcattagcgaaataagaaaaggtgccgtttagcggcccttttttttatttttatttaacaaaaatttcaagaaaagatgaagagaaaactgtaaaaagaatcagattccggacttatattacaaaaagggcgaaaaaggcattaaatctgtcatcatttatccaatctttttaggatgatgcgcataattctgttcatttttaacggcgtacagccgcttatacaaaaggaatcccgccctatatctttttgcatactcctcatctagcatagagaagagccgggggcccatcggccaaaaacaaacggagaggaatgaaggaaatgaaaaaaatgttcactgcggggattgtcggacttttgacgctttcactcggatcacctgtttttgcagctgagaaaaagcacgaagaaacaaacgtcgccgtgctgtttgacgcaagcgggagcatgatacaaaaaacagggggagagcgtaaaatagatgttgcgaaagagtctgtcacttcttttgcggaagttcttcctgaagacacgaatctgatgcttcgggtattcgggcataagggcaataataaaaactcaggcaaagccgtatcatgtaacgcgacagaaacgttatacggccttcagccgtacgccgtgactccatttgagcaatcactcagcaagattaaaccgaccggctggacaccgatagcgaaagcgctttctgatacacgtgaagaatttgagcgggccggcgctaaagggaaaaacgtcgtatatctgatcacagacggtgaagaaacatgcggcgggaatcctcaagccgaaattcaaaagctccgtaaagcgaatgtcaacacggtcgtcaatatcatcggcttcaacttcggcatgaaaggaagcgaaagccttgaaaaagcggcggaagcgggaggcggcacatacgtctcagctgacagcgcggacgagttcaaacaggcttgggaagacgccgcaaaggatttagcaaaagaataggttaaaaaaggacgcccgtgcggcgtctttttttgtttagaaaacggaaccgcgggaatgatacggataaaaggagatgaacgctgttgttaaaaggagcaggcattatattggtgctggcggcagtcgtttttgttctgatagggatttttctgaagcttgccgccttcatattcgtcagtatattggccattatcgccgcagttattttattcaccattctgagcagacatcatcgcaatgaaacatagagtccgaagagggctctttttttaaaccgcaaattcgacaaaatacagggattgtggaagaataaaagagaaggatactgcggaggggaaaacagtggatgaaaaaacaacagcggtaagagacatataccgctatgaaaaaggggtattaacaaagacggcagatcggatggtttcagagtatccgcttaccgtcatggtgaacgggcaggaatttgttacgctcgtctgcacgcctgaccatttagaggaactcgtcatcggatttctcgcatcagaaggcgtcattcgttttgaaaaagagatcaaaagctttactatagatgaaagtctcgggttcgcatatgttgaactgacgaatcccggagtgcttgagcaaaaagactatacgaagagggtcatcggttcatgctgcgggaaaggccgccatttttactttcagcaggatgtgaaaacggccaaaaccgccgtcagccggattaccataactcctgagacgtgccttcgcctgatgaaggagatgcaaagcggaagcggcaccttccgggaaacgggcggcgtccataatgcagcgctgtgcgatacggaaaagctgctcttgatgaggacggatatcgggcgccacaacgcgctggataagctgtacggctgctgtttgaaaaacggaatgcccgtccgtgacaagctgatcgtcttcagcggccggatttcctcagaggttttattaaaagccgcaaaaatcggcgtgtcgattgtcatttcaaaatcggcgccgacggagctcgcgctgcaaatggcggaagagctgaacatcaccgcgatcggttttgtcagaaacggatcatttaacgtatacacacatcctgaacgggttgaacaatagaaaggggtcttgggcttatgaatacagaaacgcgccgggtgacagacaaaaaggaaaggccgctcagggatcttcgtatctctgtaaccgaccgctgcaacttcagatgcacgtactgtatgccagccgaattattcggaccggattatccatttttacaaaagacggaattgctctccttcgaggagcttgagcggcttgcgaagctgtttgtcggccgcttcggcgttgaaaaaatcaggctgacgggcggagagccgctcatgagaaaagatatgcctgaattgatcaaaaaacttgcgcgcatcccaggacttaaagatatcgcgatgacgacaaacggctctctgcttcccgtgtatgcggaaaaactgaagcaggcggggctgcatcgagtgacagtcagcctcgattctttagaggatgagcggtttaaggccattaacggccgcggcgtttcggtgaacaaggtgcttgagggcattgaggcggcaaaagcggccggactcggtgtgaaaatcaatatggttgttcaaaagggcgtcaatgaaaaagatatcctgccgatggcccgctattttaaagaaaaaggtcatattctccggtttattgaatttatggatgtaggcaatacgaatcaatggaataaaaaagacgtgatcacgaaggccgaaattattgatctgatcaaccagcacatgccgacggagccgatagaagcgaattacaaaggagaggtcgcttccaggttccgctatcttgacggttccggcgaaatcggcgtgatttcctccgtctcggatgcattctgcgcctcctgcaacagagcgcgcctgtcggcgagaggcgagctgtttacgtgcctgtttgcgtcaagcggctatgatgttcggaaactcgtgcgcggcggtctgaccgatgatgaattgacggaatccatcgcttctgtctggagaaatcgcgcggatcagtattcaattgaccgcgcgctttctaaaacggatgggaaaaagaaagtggaaatgtcttatataggcggatgaagaaaagcttgcccggacaagggcaggcttttttattcacaatatgagagcggtctgttcaaaaaataccggtaacagccgaaatatatgataggaattttgatgcaggacaatcaagttatgcaattccaaagccatacaatatgttaaaatataaccaatagaaattagaaaaggttgtgaaaggggcatgaccgcatacgagattccgtcatctcaagttggagtcaagatcaacaaatggtacaagcacattttagcgtttcaagcggctgatgccataaagctgaaagaggaaattgatgaggatatacaacgtatggaggaagaccagctgctgctgttatattatcagctgatcagctaccgccatcatattatgcttgattacgtcaagccggaatgcaccgaacaatcacagattcagtacagcgagctgcaaaagacgatcgaaagcacggacagcatatcgggactgtctgagtattatttccatttgttcagagggatgtatgaattcgatcacaataactatgttgcggctatttctttttaccggaaagcggaaaaactcctttcatttgtcgaggatgatatagagagggcggaattccatttcaagatgtctgaagttttttacgtcatgaagcagactcatttttccatgaatcacgggattcaggcgctggatacgtatatgaaacacgatttttacagagtgcggagaattcaatgccatttcgtcatttcaggaaactacatcgactgcaaaaactacgacaaagcgcttgagcatttagacgaagccctccgcctttctttgcttgaaggacagccccgcctgatcgggtcttcgctttacaatctggggaattgttatgctgaaaagcgggatctggatgaagcggcccggtactttagaaaagcggttcccgtttttgaagagcatcagcttgaacagcttccgaaggcgctgttcagcttaacgcacacccttttcaggctgcatgatgaccaagcggcccttacctattatgaaagagggatcatgatcgcgaaagaacgcggcgaccgattcagtttagagaagtataagtttttacaagcgctttatttggagtcactcaatatggatttaatccatgaagtgtttgactatatgaatgaaaaatcgctgtatgtgtatattgaagatttcgccttggaggccgccgtttacacaagcgcacatgagcaatataaagaagcggcgtatttttatgaaaaagcgattcgcatgagagaaaaaattcaaaaagaacagtgtttatacgatatataatttttgttaaccatctgatcagcagatggttatttttttatgcacatcaggacgtttgatcatagaaaaaatcggaaaaatcgcaaaagagggaaaaaagtacgatgggaaggagggatttgttgttcggatttaatgatatgataaagtttttcgtttcatttctcatcattctcccgatggtgtctgtcatccatgtgtcgggacacagctttatggccatgctgttcggaggcaaggcgtcgttggatatcggaatggggaaacgtcttttaaaagtagggccgattcaggttcggcgtatctacttcatagattctttctgcaagttcggcgaattgcggatagataaccgtctgacgagcgcgctcgtctattccggaggctgtctgtttaatctcgcttctatctttttaataaatctgctgatcataaaagatttcctagagccaaacttatttttttaccaatttgtctatttttcaacttattatgttttctttgctcttctgcccgtgcaatacggggataataagctgtcagacggattggccgtttacaaagtgatccgctacggggaacgctgtgaaatcaataattgagagttgaaatgtttgctatcaggctgaaagggaagaaaacaagtacacaaaaacaaaaggagctgaagagatcatgagtgaagataacggtttaaaagacaaagtaaaaggcggcatgaacaaaataaaaggggaagcaaaggacaaagcaggcgacatggcaaacaagtccgacttaaaagcggaagggaaaaaagacaaagcgaaaggcagcctgcaaaagggtgtcggtaaaacgaaagataaactcagtgatgattaatttgatcgtgaaacacagcaaaagcccaaaatattttgggctttttgttatgagaaatgacaaaaattccagttcgtttggttaatattcactaaatttttaaatattctataaattccccggcgatttctttataatattcacaaagaatgtaacctttcttcacatttaattaaacgtttgttgaagaaaaaaatgagaaatcggtcatttctgcaaaaggaatcgggccgttcactgtcgaataacttttatcacttaacatttcatgaggtgaagggggtgacggccgcctgcatcgtttcggtatgaccatgcggattgtgtttgactatcactaagggggaatacagatgaaactgacaccggttgaacaagaaaaattgcttatttttacggcgggagagctcgctaagcagcggaaggcgcgcggcgttctgctgaattatcccgaagccgccgcatatttgacctgttatctgatggaaggcgcgagagacggaaaaagcgttgctgagctgatggaatccggccgcaatgtattgacggaaaaagacgttatggaaggcgttgcggaaatgctggacagcattcaggtggaagcgacgttcccggacggggttaagcttgtcaccgttcatcagccgatcaaagcggaggtgaagtcatgaagccgggagcgattcaagtcgcaaaggggaccatcaccattaacgaaggccggaagacgctggaggtgtcagtcaccaataacggaacacggtcagtgcaggtcggatcgcattttcattttgccgaagccaacggcgccctttccttcaatcgggacaaagccatcggcatgcgccttgatatcccgtcaggcacatctgtccgttttgaaccgggagaagagaaaaccgtcacgctcgtggaaatcggagggcgaaaaacggtcagaggcctcaacggcatggccgatacgtatatggatgagcggggaaaagagaagacgctgtcaaatcttaaaaaagccggatggatggaggaggcgatccgatgaaaatgtcacgtgagcaatacgcagaactgttcggaccgacaacgggagacaaagtcagactcggagatacggatttatggattgaagtcgaaaaagatttcacgaattacggggaagaaatgattttcggcggagggaaaacaatccgggacggcatggggcagaacgggcgtatcaccgggaaagacggagcgcttgatctggtcattacaaacgccgtcatcctggattataccggaatcgtcaaggcggatatcggggtgaaggacggccggattgtcggcgtcgggaaaagcggcaaccctgatatgatggatggggtggacccgcacatgattatcggtgccggaacagaagtcatttccggcgaagggaaaatcgtaacggccggcggggtggatacgcatatccactttatctgcccgcagcagatggaagtcgcgctttcttcaggcgtgactacgcttctcggcggcggaacaggtcctgcgacgggaagtaaagcgacgacttgtacatccggtgtatggtacatgtcgagaatgctggaagcggccgaggagtttccgatcaatgtcggtttcttaggaaaaggaaatgcatccgataaagcgccgctgatcgagcaggtggaagcaggcgcaatcggcctgaagctgcatgaagattggggatcaacgccaagcgccattaaagcttgcatggaagcagcggatgaggcggacattcaggtggcgatccacacagacacgataaatgaagcgggctttttagaaaatacgcttgatgcgatcggcgaccgggttatccatacatatcacatagagggagccggcggaggccatgcaccggatattatgaaactcgcatcttacgccaatatcctgccgtcctctacgacgccgacgattccatataccgtcaacacgatggacgagcatcttgatatgatgatggtctgccatcatttagattcaaaagtgcctgaagacgtggcgttcagtcattcacgcatcagagcggccaccattgcggcggaggatattctgcacgatatcggcgcgatcagcatgacgtcatctgactcgcaggcgatgggcagggtgggagaagtgattatccggacatggcaggtggccgataaaatgaaaaaacagcgcggcgctctatcgggagaaaacagcaatgacaatgtgcgcgccaaacgctatatcgccaaatacacgatcaacccggctgtcactcacggtctgagccatgaagtcggttccgttgaaaaaggaaagctcgccgacctcgtactatgggacccggttttcttcggcgtcaaacctgaacttgtgctcaaaggcggcatgattgcccgcgcccagatgggagatccgaatgcttccattccgacgcctgagcccgtgtttatgcggcagatgtacgcatcatacggtaaagcaaaccgcaatacctctattacatttatgtcccaggccggtatcgcaaacggtgtgccggaaaagctcggccttgaaaaaatgatttctcccgtacggaatatccgtaagctgagtaagctcgacatgaagctgaatgacgcgatgccgaatatacatgtcgatccgaaaacctatcaggtgttcgccgacggagaagagctggcatgccagcccgtcagctatgttccgctaggacagcgttatttcttattttaatccctctccggccggtttcccgccggcctgtttaccctctattgccaacttgatttcatcctgccgcccgttttagtgtatattagtagttgacaaacaaatgaaatgtaactattttggttacaatggtggtgaaaaacatgattaacagccgtcttgctgtggccattcacattttatcgctgatctcaacggatgaacgggcgtcatcggacatgattgcgggcagcgtaaacaccaatcccgtcgtagtgcggagaacgatcagccagctgaaaaaagcgggtattctgacatcccgggcgggtgttccgggagccagcctgaaaaaagatccgtcggagatcaccctcttagaggtttacagggcggtgcagaataaggaagagctttttgcggttcacgacaatccgaatcccgactgtccggtcggcaaaaatattcagcgcgcgctcgatgagacgttcggaagcgtacagcgggcaatggagaatgaacttgcgagcaagtccctttatgatgtaatgaatcatctcttttgttaaaaagagatgggttcatgccgctagacgtgtaacggaaatggttacaatgggtaatgaggaaatcacggttttggctccatattcagacaagcctggatgcgggattgcgatctgtttaatgaagaaaacctccgaaactaaaggaggtggtaaccgggatatttttattttgcttaaggcttatgtgaaggtgtctgttgtaagcgggttaccaaaaaaagacggaactcttattttaatacgcgctaaaaaaactgatggagaatatcctgcctccggtaatgccaaaaccgttcgcctcttcacaatcattataaaatttctcaaggaacgatcagcagcccgttagctgcccctcattagagatgagctgttaccacactgttacattagaacttccgctgcttttatatccttctgtcgctaagacttgataagcccaattactgcccagattcattccatggctcttccatgcgttaacatgattgctgaaagtgattgcagcgttgcttccggtcggtctcttcgactggcggacactccagtactgcgtaaaagtagtgttatcgccatcaatggaaggtgcgttataacgtgtcgttgtatatatgtcatatgtacctccatcactctttacggtacctttatacgttccggtaggtctgtaagtaccccatgaatccaccacataatattcgatgaggggcgatctcgtccagccatataaagtcaaatatccattgccgttcggcgcccaaacaccggcattatagtttattgttctaaatggcgagcctgtagtccagcctttaccaacaacgaaattcccggtattagaccaattaacactgtaatttccgccagagccattgactgcgtttactgttccgcccccgtcagtccaattttgccagtaatctgtgccagctgcagaggcggttgccgaaaacatgctgatactcatgaaagctgccgttaatcccactaagaatttctttttaaacttaaacatatgttacctcctatactattttttctgactttgacatgaggcagcactcgtaaatatttaacgaacgccaacgcttttgatcgttcctttcaatataatagcatgaatacatgggtgaatattaagaacaattgtaatttaattacaaagacccaaaaaattgtatgatgagtggtcttgtaccgccatagccttatttcgcagaactcagtgatttcagttaaaactctgaggaaacgttttatttgaaaaaacttttttgccgaaagaatatctgcatacagcgtcaatgctgttcgccgtattggcaaatccgaagcagaaaaactttaccgttgtcggagaagcggaataagaaaaaatcccgggcggatgcgccgggattttcctttttaatatgtattggcatcaatattattaaacgcgtcgtccacgatgccgagcgtcatgaggacaatgaaaagaacgataccgagaacggacaagccgaccgtcacgatcagatagatcccctgcattttcacgaactttgcataattctccagcatatgttcctctgtcagttcattgaactgcgccgccatctgtcccgcttcatttgccgagcgcatcagaaaaatgccggcaatgatctgcagaacgccgggaatggctccgattaaaaagaaaaacgcgcccgaaagcgccgcaaacgcgcctataataataaacaaaatacctgtcgcttttccccatttcgaaatagaaataagcgaacgattcactgattcaggtttcaaaccatggcactcctttacaaaaaaatactcacttttcatttatacactattcggtcattcttttgaatataaaatgtgttttttcaagctgtgtccgtttttatatcagaaaattcccgagaaacatcccgggaattacaaaatcggcgacagaagccttgaaatcgattctttaatgcggatccgcagcgaacgctcctgatattcttcatacgtatattttctggagacgagcagatcttctttaaatgaggaaatgagttttttcgcgatggtgacgtcataaataaaggcgttgacttcaaaattaagtctgaagcttctgacgtcgatattcgccgtaccgactgaagccgtctcatcatcgacgacaatcgtttttgcatgaataaagccgttatcgtaaatgtagactgaggctccggctttcaaaagatcgccgatgtaagataaagtcgcccagtaaacgaaagcgtgatccggcttgttcggaatcatgattttgacgtcaatgcctgacagacaggcgatcctgagggcatccaaaagacttgagtcaggaataaagtaaggcgtctgaatcaggatcgaccgtttggccgttgagatcatcttgatatagccgtttttaatttgttcccattctgaatccggtccgctcgtgacaatctgcatcccgacattgcccttcggctcgcattccggaaaatgattcggaacgtaagtgagcgtatggtgatgggaagcttggttccaatcgagaataaaccgtgtctgaatggcgtgtaccgccgtgccttgaagtctgaggtgcgtatcgcgccagtagccgaatttcggattcaggccgagatattcatctccgacgttaaagccgccgacatagccggtttcgccgtcaatgatgacgagcttgcggtgattccgataattgagccgcaaattaatcggacgaagcctggaaggaaaaaagacttccacatggccgccggcgtcccgcagcggtttgaagaatttttttctgagtgatcttgaaccgagttcatcatataacactctgacctttacgccttcccgtgcttttttcactaaggcatcgcgcaatttttttcccagttcatcacctttataaatatagtattgaaggtgaatgtgatcttttgcgttggaaatgtccttcattaagcgtttgaacttatcgcgcccgtccgttaaaatctccaccgaattatcctctgtaaagactgcgtggttgttcatgacaagcatatagatgaggtctttattatccacagtcgccctgttgttaaattggaattgcctcgacttcagatctttcagctgaaacttcagcagcttttctattccgatttttttacggtcttcccattgaaacaggtgcttgcgtctcaggttatggccgaataacaggtataaaataaaccctaaaatgggaataaaaaaaagaaccaagagccaagcccatgaagcgctggcatcgcgtctttctttgaaaatcatgatgacggccaaaagtatatttaaaacgaaaaaaaatccgaataaaataaatgaaatgctcactttgcaaccccgctatatcatatttatcaagactgtgcccattagtattccgacaagtgcagcaatctgattcccatttcaaattataacattgacattttgaaagaataaagagccggaatcaaagatgaatgcagttttctttcaaagaaagttccgggtgcggtaaaatatgcatatatgaaaaagaagacaaaaatgacagcaaaggggagagggcatgaagctggagcatgcggaacaattgccgggattcataaaaaaagaaattcagaaaatacaaatcgccatcgcgccgctgatgaaaaaaagcatcatttaccgttttcttgctttcccgctcgccgcttttagtctgtttcatctggcatcgcttttgattcaggccccttccgggagaggagctctcgtatcggccggcatttttgccctccttgcggctctgggtcttgcgttttttaaggaagccggctatcagcggaaacaggtgcaaaaaacgatccggctttatatgctgaacagaatcagaaaaagcgatattctgtccgaggaacggaaaagcgcctacacccggctgattgccgaggagccgtctgcgatgaagagctttattgaatttttaacggaagaagaccggaaaaaagaaatgctgtattaaaaaagagctgacgcgcgatcagctctttttgtcattcaaacacaggatcgttctcatagtaatatgaatcaggcgtgtcatacgtatcagtgctgtaataagccataattccgatgacagcgaagatgacgactaaaataaaagcgagaatgcccagtaccacactggatgccgcgtaaaaaaactgcattttgataaatgacgcataatgtgcaagcatattttcttccgcgttttcttctagcccttcctgaagggcggcagccgcttttgccgagcgcatcagcatgacgccggaaatgatgagcagaacacccggaatggctccgagcagcgtcacaatggctgacagagcggaaagagaacctgtgatgatcagaaacacggcggtgatctttccccatttggcgatgtcggcaagggaacgggcttttttattgagcggctggttttcgtctttgtctttatcgatggtgatcatgacagttctctccctaaaatgttcaagtcatatcgttttccgtccatttcggcgatacccgggaatacgccccattcggtaaaaccgaatttttcaaacagcttaatgctcggcacattatgtccgaagataaaagccatcaggctgcggatgccgattgccggagcgagtgccagggcttctttcagcagaaagcttcctgctcctttgccgcggcaatcctgatgcagatagatgctgatctccgccgttttgtcataggccggacggccgtaaaacgtttcaaagctgatccaggccgccactttgccggtttcatcttccgcgaccatcagcgggcgccggtccgtgtgccgcaaaaaccaatccatctggtctgcgggcgtcacttcttccgtatcagccgttaccattcgtgaggcaatcgtcgagttgtatatggccaccaccgcatctaaatcctccaatacggctttgcgcagggttaaattcatattccgggatctcccttcacatttcattacataattaagtgcaatctgcacatactacttctaaaaaagttttttatggatgtgtatatattttcagaaaagtgttcagaatgttgctgaggtgatgaacaaatgagagaggaagaaaagaaaacttctcaagtcaaaaaacttcagcggttttttcgcaaacgctggatattccctgcaatctacttagtcagtgcggccgtcattttaacagctgtcctttggtatcaatccgtttcgaatgatgtgaaggacaatctgacgaacaacggcggaaactccgcgtatgacagcggcaaagacgatgccgtcgaagtaggcaagtcaatggaaaacgtcgcaatgccggctgctcattctgaaaatgtttctgttgtgaaaaagttttacgaatctgatgccgcaaaaaaagagaaagaagcagcacttgttaactataataacacgtacagcctcagtaaaggaattgacttagctgagaaagacggaaaatcatttgatgtttctgcttctctgagcggtacggttgttaaagctgctaaagacccggtactggggtatgtggttgaaattgaacactcagacggcctgtctactgtctatcagtctttatctgaagtcagcgtggaccagggcgacaaagtaaagcagaaccaggtcatcggtaaatccggaaaaaatctttacagtgaagaaagcggaaatcacgtgcactttgaaatccgcaaggacggcgtagcgatgaacccgctcaattttatggacaagccggtaacatctattgaaaaagcggcggctgaagagaaaaacgctgtgacagaagaaacggaagggtcaattcagcagtcttccgagaaaaaagatgtgacgcctaaaaaagaaaccgaagaaaaaccaggtgacaaagaagacggcacaaaagacaagacagatggtaaagatgacggctcaatgaaagattcgggcaagtaatcttgatcccaaagcgtctatcagctctgataggcgcttttcatattgctgcatgtgcctttatactaatagaaaacgaaggagatgctgaatgaataaatgtctggcggccgggtggctcgtctttgttttcgtttctgctttgactgaaagctttcacgatatgattgtgtcgcagacggtgtccttccgtttcacgtcccatccggatgtgtccggtttctttgtgttcgatatggcggagctcgccataccggaagcggcgattcaaaagctcgggcacgcgttttcattttttgtgctcgcctatttgtttttcagggagcgcaggcgcatgaagagggcggtgctgtatgcattggccgccgctttcctgacagaaatcgtccagctctttttcggcagaaacggatgcctccgcgatgtgctgattgacagtctcggcattgccgcattctgggctttacaaaggaaaaagcatacagccaaacatacaaaaaccggcagtctgtgacagacgccggctttttttatatattatggtttgtcgatttgcttttatgaacgatactttcatagattcgcacgatcagatcgacaatcggacgaagcacatttgaaaatctgaacagcaggaatccgacaatgagggaaacgataatgcttccgagcacatcgatcggataatgatggccgacccaaattcttgagaagccggtcaaaaggccgaaaatcacaagcggccagccgagttttttgttgcggaacagaatcgcaattgaaatcgccaaagcgcctgtcgtatggtcactcgggaatgaagcatccgcggcatgagggatcagcgtatgaaccgtatgctcgacaaaggggcgcggctcgacatagactttcgtgatgaggtagttgatgataagcgccgcaacacccgtgaagcccgcgtacagggcgttttgtctgccttttgtgcttccgaacagccacatggcaagcaggaaaagggcgtaggcgtaaatggcgtattccgttataaaaaccatgatagagtcgagaatggcactatggtgcgacaaaccattgatcgctttaaatagttcgtaattcacaaatatcaccttttatctttattttatatgaacagtgtaatgcttttttctatgagacacaattggtattaaaaataatcataaaaaagtaaacagaatgaaacgtgactgtattactgtgcgtcaagtatgcgggaaaagaatagccgaaggagttttgtccgttgctgaaacgtttgaaaaacgccgatctgccgcttgtgtttgtcattatgctgctttgcggattcggcttgttaatggtgtacagcgccagtgatgtgatggggtctcagcggtacggagatccatcctatttcttccataaacaaagtgcctctttactgatcggattatgcttatttctatttgccgcctgtctgccgtataagcggtatgcgcggcttgtaccgctgtttgtggtcggttcgctggtattgctgctgctcgtattgataccgggaatcgggctggagcggaatttttcccgcaggtggctgggagcgggcccgcttgtcgtacagccgtctgaattggcgaagatcgccatgattttgtatttcgcttcggtttatacgaaaaagcagccgtacattcatcaatttgtgaaaggggttctgccgcctttagtaattttggggaccgcttttctgctcactttggcggagcctgatttagggacggcttccttaatcctggcggcgtgcgggtcgattttattatgtgccggcttgaaaaagcgccatcttttcgtgctcggcgcgacggcggtgtcgggggttgtttatctcgcattttctgcatcctatcgtgtgaagcgcctcgtttcctttaccaatccgtttggtgacgcgaacggggacggctatcagctgattcaatcctattttgctatttccggaggcgggtttttcggaagagggcttggaaacagtgttgaaaaaatgaactatctgcctgaggcgcataccgatttcattatggccgtgatcagtgaagagctggggatattcggtgttctgatcgttttgggattatattttgcgttaatgcttctcggcgtaaaaacggccgtgcgggctgatgacccgttcgggaagcttcttgccatcggaattacgtttcaattaatgtttcaggttgtcttgaatttgggagcgatgagcggactcctcccggttacgggtgtgccgcttccgtttatcagctatggcggttcttcattgattatgacgctgtttttgtgcggcatactggtcaatatcagtacatatgcgaaaaaacaaaccgtacggcataagcgtcctgccccgcatgaaaaaaaggcttcttctttttaatgaagcccgaaaaaaacgcccgggacatgctgtctccgggcgttctgtctgtttataaagctcctggtccttcttctccggtgcggatattaatcgtgtttccgatttcatagacgaatattttgccgtcgccgggctctcccgttttcagcacttttttcgccgtttccaccacttgatcaacggggaccttgctgacaacgatttccactttcagccgttcatatacattgctttcaattttgactccgcggtacagttcggtgtgagctttttgaaggccgcagccgtgtacgttggagaaggtcagcgatgtgactccgattttaccgagttcctgtttcaatgtttcaaacttagccggacgcgtaacgatttctaccttgaacatttgaccgctcatctaagccactcctcactttataagtcctgatatgctttttccccgtgcatcgttaaatcaagcccaagtgactcttcttcttcgctggcgcggaggggaatgaacagacctacaattttaatgataacgaaagtgacaataaatacaaatacataggttgccgcaatggccgcaatctgcttccagagcagtcccggatcgccgtaaaacagtccgtttgccccgccgtcattgacggaagtggtggcgaataaaccggtcgcgatgccgccccatgtcccgccgattccatgcaggccgaaagcgtcaagcgcatcatcgtatccgaaagtctttttgagccaatacacgccccagaagcagacaagcccgccgatgaaaccgattacgatggaagagaacggcgtaacgaacccggcagccggcgtaatggcgacaagcccggcaatagcgcctgatacagcacccagcatggtcggttttttgttcagcatccattcgattaaaatccagccgataattccggccgcagccgcggtgtttgtgttaatgagggcaaacatcgcgatactgtcaagcgtgagggcgctgccgacattgaagccgaaccatccgaaccaaatgagcgccccgcccaagaacgtgtaaattaagttgtgaggcgaagccgccgtgccgtccttgcgtttcccgagcacaatcgccagcacgagcccggcgaccccggaagaaatgtggacgacgtttccgcctgcgaagtcaagagcgcccatttggccgatccagccgccgccccatacccagtgcgcaacgggcgtatatacgagggaagcccacaaaaaggaaaatacaagaaaagcactgaatctcatgcgttcagcaaatgctccggaaataatggccgtcgtcagtacggcaaacgtcatttggaacatcatgaataatgaatgcgggatcgtatcactataacttccgggttcaaagccgacccccttcagtccggcccattcaatcccgccaagccatgtattcccgggggcaaaagcaagtgaatatccgtacaaaacccaaacgacggatacgatggcgagggaagaaaaactgtgcatcgccgtgctgagcacgtttttgctttttaccattccgccgtaaaacaaagccagcccggggtcatcagccacacgagtaaagcgcaaaagaacataaatactgtatcgcccatctgcatgttgtattcctccgtctcattcaaaatgtaatcgtgattaattcattattatagagaaaaaagaacgataaaacattttcgtgtaaggttatctgacatgtttttttgcgttcataatgtcgctttttcaaaggggtgtcatgcgactttatatccataaaaagagcgctggagcatggcggaagaaatcctgtccgggaaagagtaaaataaacggggtgagaaacactaactgcatcaggaggaattattatgacaacatcattgaatctgcaatttgaaaaaacggctttggtccttattgatttacaaaaaggcattgtgccgatggataaaagcggtaccgttgtgccgaacgcgaaaaaattaattgatgtgttccgggaaaaaggcggatttatcagctttgtgaacgtagattttcatgacggagcggatgcgctgaagccgctgacggatgaagaggcggcgggccattcggctccgccggcggattgggctgaatttgtgcctgaaatcggagtgaaagaaaacgattatacggtaacaaaacggcagtggggcgcgtttttcggcacggacctggaccttcagctcagaagacggggaatcgacacgattgtgttatgcgggattgcgacaaacatcggtgtggaaagcacggcgcgggaagcttttcagctcgggtatcagcaagttttcgtaactgacgcgatggcgacattcagcgatgaacagcacgaagcgacactcaaatttatcttcccgaaaatcggcagaagccggacgacggaagaatttatcgcacagacaaaatgacaatctccaaaaaaagccgcgtcctgttcttgacggccgtggcttcggggacgatgctgaacccattgaactcgtcgatgatttctcttgcgcttcacagtattcagcatgaatttcacctgtcgtttacaacggtgtcctggctgatatcgtccttttatcttgccagcgcggtggcgcagcctgttaccgggaagctcggtgatatgctcggcaggaagaagctgtttttgatcgggcttctgcttgttgccgtctcggcggtcggcgcgccgtttgcgccgacttttatgacattgctgatcatgcggctttttcaatcgatcggaagcagcgcgatatatccgtccggcgtcggattgatccgttcaaatatacaggagaagcaggcttcggcgctggccgtcctgtcaatctttgcatcagccatgacggcgctcggtccgactctcggcggttttctgatcgtttggggagggtggccggcgatctttttcgtcaatctgccgtttatcatcctcagtttttttctcggaatgtatatgtttccgaaagatgaaaaacgcgagatcggcggcttgaaaggcgtgctccgccagcttgatacaatcgggatactcctgtttgccggagcgattatccttctcctgtcgtttttattgtccttcagtacgaagcctcactatacagaaggcgtattcgggcttttatttgtcgggctgtttatctggcgtgagctgaaaacagagaagccgtttattgatgtcaggctgtttaaaacgcatcggaaactatcgtcggtgtatattcaatttattttgctgaatatattcttttactgcatctttttcgggcttccgagctattttcaggatgaaatgcatttgtccgttcagacaagcggattgattatgctgtttatgtcgggcatgagtattctggtgtcgcctttgaccggaaaatggatagataagaaagggcttcttcagccgattgttgccggaacctgcctgaccgcgatcggagcggtgctgttaacgtttttcttccttcaggcgcccatgataggaaaagggctgatcctgtccgtgctgggtgtcggctacggtttcggaaatgtcacgtttcaggcggccatgctgaaaacgagccccgccgacatggtcggaacaacgtccggcctgtttcagacctgcaggtatctcggttcgattttgtcttctgtcattttgggcattcttttcggaaaagaaattaccgccggccattttcatatgctcggcacgattcttatcgttgtcggcgccgtaagccttttgatggcgttccggttttcggttctcctcaaaaaagcctcttaacaggcgcaaaaaaaagagacgggctctccccgtctctttttttgtgtaatgtgctcaaaaatcaaaacgattattgtcgacagcgaccaatgttatttgcggaattttcagttatattttttcacatgtgatgtaaggaaaacgtacatgcaggagggagaaaatgacaaaaataacgagtgatcggctaagcaacaaagatttactgcctttagaagacggcgaacggacatggaaggcggtgaattttgcatccatctggatgggttgtattcataatatcccgacctacgcgactgtgggcgggctcattgcgatcggcctttctccgtggcaggtgctcgccattatcgtgacggcgtcactgattttgttcgccgctttggccttgaacggccatgccggaacgaaatacggcctgccttttccggtcattatcagggcttcttacggaatatacggagctaacattccggcgcttctcagggcatttacagccatcatgtggctcggaattcaaacatttgccgggagcactgccttacacattctgcttttgaacatatggccgggctgggggagtctcggcggagattggaatatattcgggcttcatctgccgggctttctgtcgttcattttcttttggggcattcatctgcttgtgctgcggcacggcatggaatcgatcaaaaaatttgaagtgtgggcgggcccgcttgtttatctcgtcttcggcggcatggtctggtgggcgatagatattgccggcgggctcggtccgatttactcacagccgggaaagttccatacattttctgaaacgttttggccgtttgccgccggagtgacgggcattatcggaatatgggcgacgctgattctgaatatccctgacttcacccggttcgccgcgtcgcaaaaagaacagattcgcggccagttttacgggctgccgggaacgtttgcgctgtttgcgtttgcaagcatcacggtgacatccggatcacaggtagcattcggagaaccgatctgggatgtggtggagattttggcccggtttgataatcctttcgttatcgctctttcggtcatcacactttgcatcgccgccgtctcggttaacgtggcggcaaacatcgtgtcaccggcctatgacttggcgaatgtcctgccgaagtatattacattcagaaggggagggtatttgaccgccgttttggctctgttcacaataccgtggaagctgatggagagcgccacgaatgtatatgcgtttctcggactcatcggcgggatgctcggaccggtggccggggtgatgatggctgattattttatcatcagaaaaaggcagctctcagttgaagacctttattcagaaaccggacagtacacttattacaaaggctataattaccgggcctttgccgcgacgtttctcggcgcgtttatttctttaatcgggatgtacgtcccggcgttcgccggcatctatgatatctcctggtttgcgggtgtcattttgtcatgtctcggttatacggcgcttatgtacattcatcctccttatgcaaaagcggagggacgaatcgtgcgggaaagagcggccgaataaaaaaagccgggggctgcccccggctttttgtcatatcagtctgcgattgaaacgtttccgtccgcttcaagcggcgttctttttttctggctccagccatacaggagcaaagcaatcaggacgaacagccccgctgccagataaatcgaatggaatccggccgaagcgacgaagaggccgaatacatatgacccgccggcaatcccgctgtcaaagaaagtgaagaaggtcgccgtcgcaaagcctgaacggtgtccgggcgaattctgaatcgccagcgtctgcatacacggtacgatagagccgtatccgagaccgattacggcaccggacaagagaagcatgagggcgctgtttgtcatcgccagcatgcaaagccccgcggagaacacgataatcgacggatagatgacgattcccggccccactctgtcaaacagctttcctgtgaaaggacgggcggccatcatcgtcacggcgaaacagacgaagaaatagccgctgacatccaacaggtggatcgtctttgcataaacggataaatatgaagtcacacttgaataacagaaagaaatggacaacccgacaatcgcgattttaagcgcgcctttttcaaacatgtcggagaaagaaaaacggaacacagtcgttccgctgttgttttgatccggcacacgaatcataaaagcaatcagcaagcctaaagaaacaaatacagcaaaaagcgtaaagaacaccgggaacgatatgactttcacaaggctcagtccgagaaacggaccgatcgccatggcaaggttcatagacatcgcaaaataaccgagcccctcgccgcgccgcttggcgggaataaggtcagcggcaattgcgcctgtgaccgtcgttaaaatgctgaaccagatgccttggaaaaaacgcagtccgagcagcagatagaaattgtgtatcggcaaatacagataagaagacagggcgaacagcgccagagatacaatcgtcattcttttcttaccgaaccgttcaataatcgcccctgaaaaaggacgggtgataatagcagataacaggaacaggctgatcaaaagccctccttgcgattcactgccgccaagctcctgaatcatatagataggcagcacggccaaaaatgtataaaagaacacaaagacaaataaatttacgagtacgaccataataaaatctttggtccagatcgagtcagatttactcaaaagtacagcacttccctttctttattatttcgttaaaaacacattcagaaactcagaaaaagcttccttatctccatcttggaaatccgcaagcatgtcttcctcgaacttcagcatctcttgattgatgctgttgtatttcaattcagcttccttcgtcaggacgacgagcttttcccgcttgtcttctccctgttcccgctgaatccagccgttttcttcaaggcgtttgatcgttctggtaacggtcggcgcctctacgttcagataagaccagatttctttttgggtcatcggtccgatcgtttttaagcaatataggattgaccattgagaggagtacaggccgaatggttccagccgttcattggctttcttcgtaatcaggcgggcgcattgattgatttgatgaatgaggcgtctgttgacgtggatcatttccgttctccttttcaaaaaacttacctaagtaactaattgtgctgtttcattctacagcaggatcgcgcggatgtaaaccccccgttcaaaaagcagaaaattatgacccgccccttgtccttattgagtttttagcatattcccaattcattgctaatacactgttacaaacctatcaaagagagtgtttgaggtgagggatcgtgggcatatttctaaaaccttcttatataatcggacaacgaagaagctgcatcatcagtgaatctgttacagaatacggatctcatttcacacttctcacatccaactggggaggtcgagtggtgtgcacgattacatcaaagagcgaacaatcaagattggtaagtatatcgtggagacgaaaaaaaccgttcgtgtcattgcgaaagagtttggtgtttccaaaagtaccgtacacaaagatctgacagaacgcctgcctgaaatcaatcctgacttggcgaatgaagtaaaagaaatactcgattatcataaatccatcagacatttaaggggggcgaggcgacgaaattaaagtacaagaaggatgaaattcttgaaggggagcccgttcagcagccgtagcgcctgacgtctgccgggcccttttttctcctccgggcggtttcgcgaatatccgcaaaattttgtcaagaacttatatcgatcagcagcttttttttgataaattatgataatatatataattagggcacaatgtggatattttactgtgaaacagatatcaaggaggatataaatagatgtttgcaagggatattggaattgacctcggtactgcaaatgtactgatccatgtaaaaggaaaaggaattgttctgaatgagccttccgttgtggcacttgataaaaacagcggcaaagtgctggctgtcggtgaagaagccagacgaatggttggacgtacacctgggaatattgttgcgatccgtccgctgaaagacggcgtaatcgcagacttcgaagtaactgaagctatgctgaaacatttcattaataagctgaatgtaaaaggacttttctcaaaaccgcgtatgctgatctgctgcccgacgaatattacatccgttgagcagaaagcgattaaagaagcagctgaaaaaagcggcggaaagcatgtgtaccttgaagaagaaccgaaagttgccgctatcggcgcgggtatggaaatcttccagccgagcggtaacatggttgttgacatcggaggcggtacgacagatatcgcagttatttctatgggcgatattgtcacctcctcttctattaagatggctggggacaagtttgacatggaaatcttaaattatatcaaacgcgagtataagctgctgatcggtgaacgtaccgctgaagatattaaggtgaaggtcgcaacggttttcccagacgcacgtcatgaagaaatcaccatccgcggccgtgacatggtttccggcctgccgagaacgattacagtaaacagcaaagaagtggaagaagcccttcgtgaatcagttgccgtcattgtgcaggccgccaagcaggttcttgaaagaacaccgcctgaattgtccgctgacatcatcgaccgcggcgttatcattaccggcgggggagcgctgttaaacgggcttgaccagcttcttgccgaagagctgagggtgcctgttcttgtcgctgagaacccgatggattgtgttgcggtcggaaccggcgtcatgctggataacatggacaagcttccgaaacgcaaactgagctgatgataaaacctcattctgaaaaagaatggggtttttttctgtcaaacccttcacgaacgggaatgtaaatccgataataagaaaaaatgctgattttcattatagaacaaatgttccggtgaggcaactggaaataatgctatttcagaggtggaagacttgttaaaaggattatataccgcaacgtccgcaatgattacacagcagagaagaacggaaatgctgtcaaataacatcgcaaacgcgaatacgtcaggatacaaagaggatcaaggttcaatccgcgcctttcccgagatgcttctgagccgaatagaaggcgataaaaaaacgaaaatcggttccgtcaacacaggcgtatacatgcaggagctgaaaccgttgtttacgcagggaagcctgaaaacgaccgatcagccgacggatatcgcgcttatggagaatcaggttcccaagaatgccgaaacgaatgaaaacgccgagctgttttatcccgtgcagactgcgggcggcgtccgctattcaaaaagcagcactttctcattaaatgaaaacaatcagcttaccataaacggaaaccttgttttatcaacaaacggacagccgattacagtcgacaatgaaaaattcaccgtatcagaaaacggaacggtcacgacaaacggccggccggcggggcagattgacatcaggatggaagaagacgtgcgcaatctgaaacgggacggcaatgacctatacagcacggccgacggcactgaactgccgagcgcggcggcgaatccccaggtctcgtattcattaaagcaaggcgtctcggagctttcgaatgtggacgtgacgagcacgtatacagaaatgacggaagcatacagatcatttgaagccaatcagaaagtcattcaggcttacgataaaagcatggataaagccgcaaatgaaatcggcaaagtgtaacaaaatgggggacgttcaattatgatgctcagatcaatgctgacggcttcaacagccttaaatcagcttcagcagcagatggatacagtcagcagcaacctttcaaacagtgatacgacaggctataaagcgagggactcccgcttttccgagctgatcagacagcagtatgaccatatagatgacaaaaaggaaaattcgccgaacatgcggaaaacgccgcccggcctgcgtctcggcgccggaacggtcatgactccgcagctggactcagggcagggaggcatcaaaaaaaccgaccgtgaccttgatatcgcgttcacctcaccttatcaatatcttcaggcagaagcggacggacggcgggtgtatacaagggacggctcactttccctcaagccggccggcggaaatgaccgggtgcttcagctgttgacagcgggaggcaatcccattctcgatgagaacggccagcccatacaaattgacagttcgctgaatcagctgaaaatcagcaaaaccggaacgctgactgcttcagacccggcaggaacccgttcgcagacgtttaatctcggcatcgtcaatgtcaataatcctcaggcccttcatgcggaaggggataatctgttttccgtaaacggagcgggggcatcagcgattgaagagcttaccggcgcaaaccggcaggcaatcggcatggagcagggcgcgcttgaaagttcaaatgtcgatatgtcaaaagaaatgaccgacctaatcgtgtctcagcgttcctatcagctgaacagccgcacgattacattgggagaccaaatgctgggcttaatcaactcagtcagataaaagaaggggcgttttgatcagccgcgcatgataaaaaatgcggctttctcaaaatcgcccttttttttgtagtaatcagtaatatcctgaagcagcacttccaaatccacccacgcttcaattttctgcagctccagcacgagtttctgcaatcggtcgtacgggtcctcctgagcggtgtacagtatgttgagcgcggtcagcttcaatttcattatcttgttctgcactttttcagatatgtataaacctttctgcagcacggtttgtccttcggcggcatatccggttttaaaaagtgctctgaccgcttcgtatacacaatgcaggtaggaaacgggagactctttctcgaaacgctgattgcccaatacctttttgtaaaaagggagggcctctttatcttttttctgggcggtctttaaaaaaccaaaattataataggcgtggcacagcaggttattgtcattgatccggtccgttatctttatggattcattaaagagctgttctgcgtcttcatagcgtgcctcgtctatgtaattcacggcgagaagcagacggcagctgagcgtttttttgatgtaaccgaattcaccttgatagatttccagcgctttattgacatattgaatggagagcgcaggcgacttcatcatgtaatatgcacccgctgttttataataaaattcagcggcttcgaaacggtcctgaatggccggcaggtactgttcagcttctttaaagcggcagacagcacggttcggagcgccattcaccatatggaataaccctttgaaaaaatagaaataataagttaattcatggtccatctcatctttgcgccgcttcagctcgcagaacaatttagtcagaccgtcttttttctcaaacagcagctgaaaccgtgcgaaaaacagctgatatctgagtttgagctttgcattcttttgtaatttggggagatgctgattgatttgttcgtgaagggaacgggctagatcgaattggcgttttcccatggcgtcataccactcattcagcatcaccagcgtacgtttttcagtaaacttagcaatcatcttccaacctctttgcatagggtaaaaatctttatttatcataacacattaatggacgaggctcattgccagctggttacagtttacagcgcggttgaaaaagaaattgattcataatatacttccaaatgtacagattggttagcgcatataccttctatacatactattgtcgatgaaggagatgtcaagaaaatgcttgatactcagcaaattaaagaaattattccccatcgctatccgtttcttctggtagacagaattacggaagtcgaagaaggaaaacgggcggcgggatataaaaatgtgacggcgaatgaagattttttcaacggccattttcctgaataccctgttatgccgggcgtcttaatcgtagaggctttggcgcaggtcggagcggttgcgatgctgattaaagaagaaaaccggggcagactcgcattttttgcggggattgataactgccgtttcaaaaagcaggtaaaaccgggtgacaagctggagcttgaggttgatattacccgcgcgcgcggtacgatcggacgcggcaaaggcgttgccaaagttgacggcgagctcgtgtgtgaagctgaattaacatttgcgctcggagaataaaaacaaacgaatgggcttataaaaaagcccattttgtatagaaaggggtgaatgtaatgtggtcagaatttaaaagctttgcgatgcggggcaatatcatggatctggcaatcggtgtcgtcatcggcggcgctttcggcaaaattgtgacgtcgctcgttgaagacatcatcatgccgcttgtcggcctgcttcttggcggtcttgacttttcagggctggccgtgacattcggcgatgctcatatcaagtacggaagcttcattcaaacgattgtgaacttcttcattatttcattttctatctttatcgtgatccgtacaataggcaagctgagacgtaaaaaagaagcagaagaagaggctgaagaagcagaagaaacagatcagcagacagaactgctgactgaaatcagagatctgctgaaacagcgggctcctcacaatgactaaggcacaaaaaaaggctggatgattaacgtccggccttttttatgattataatttttgtttaaacgcttcaatcagccggctgcccgagtagccttctttcacgagcgactccagaatgctttctgatccggggtggtttcttgacaccatttgaccgtaaattaaaacttgtatactcttttccagctccacaatatttttgatgcttcccgtcagctgggcggggcggttgctttttttcgtaatcgttacaaacaccttcgcttctttctggcttttcatcagcatgtcaaaaaaagaaaagtgttcggccgggaccagtgcttcaattaaccagtggttttctccgtcctctttgttgataatcaatccgtctaaaaggggaaactgttcaatcggctgatcgtctttatctaaacgttccacattcagatcaaccagtttaaaggttttcatctcttattttcacccctgttgtccatgtttttcgttcatttattataacacatatcatttttcccgggaaaatgctgtaagacatgcttcatcatttttgtaggcggtcaacatttaatcatttctattttttcattataatgtaaaagaatatggtcatggagagatgcttatgaatcaattgcgcctgaaggaaatctatatagaagacggttcaaggcgaaaagacgatcattcctacttggtatgcaaaaaggaagattgtgaggtgcatcttaacagaaggggaaatgtcgtctttttatatgaaacaaaagaccgcatggaacagtataaaattcagctttcattgactgataaaaagctgagtttttactggttcgcatgggacggcggaaagtttgtccgcatgtttgagaaagactggctcaaaacgaaacttttctcgcggctgctcaaaaatacatattacataagcggtcaaaaacaaaagttttttttatcagaaagaaaaacaaaaacataaaagcagcccaaacggataaaggctttttccgctttttgctttcataagcctttatactacaatgaagccagcctcgaaaaagagaggaggagacggcttgtttaaccacgttatgcttgtcggccggctgacgaaagacccggagctccgttttacatcagcgggcattcccgtcgctcatattacgttggcggtaaaccgcaattttaaaagcgcgtcgggtgaaaccggaaccgactttgtcaactgcaccatctggaggaaaaacgctgaaaacacggcattgtactgccaaaaagggtcaatggtcggtgtaagcggcagaatccagacgagaagctatgaaaagacagacggcgtaaaagtttatgtgaccgaggtcatggctgataccgttcggtttatggatcaaaaacggaaagagccgctggctgaatagcatgcttttttcctcgatttcccgcctttcagcgggccccgcaatacctccttcccattcgccagtcgaaagactggtttttttgtgcgggagctgaaaaatggttaaaaagaagtgatttcgcttataaatacttaaaaacattgaatatattgggataaaaacttataattacttacagataagtgacgaaaaaaagggaatgaggacgtgtatcaagaagaaagactgattgcgataatggaatatttgaaacagcaccggcggatcaccgctgaacagatatgttcgctgcttcatatttcaagagataccgcaagaagggaccttgtaaagctgaaagagcgaggggccattatcagaacacggggcggcgcgattctgccgtcagtgaatcaggaagttccgggctattcgggccggctgaaaaccgtttctgaagagaaaaacaaaatcggcaagctggccgcatccctgattcataaaggagaccggatcatcctggacacatcgacaaccgttcaggcctgcgcggagcatttaaatgtcaccggctgcactgttattacaaattcgatcaatcaggccgatatcctttccgcaaaagagggaattgatattcacctgctcggcggaaagctccagaaggaacaccggtttttatacggggcttccgttgtagaaaaactgggggattatcacgctgataaggtgctgatcggcgttgtcggcatctcggaaaacggcctgacgattccgcatgaagaagacggcatggtaaagcgtaaaatgatccgtcaggctgaacaggtgattgcgctgagcgatcactcgaagcttggccgtacgagtttttatcagtatgcagacctgcacgaggttgacctgctgattaccgatcggctgcctgatcaggatttttgcgatctgctcgaccggcacggcgtagaattgcttgtaactgaatctgaagaagaggatgaggacatgtgaaactgattgccatagatctggacggcacactgctgaacagcagtcatcaagtaagtgatgaaaacaagcgggctttaagggaagcccggcaagcgggaattgaaatcgtggtttccactggacgcgcgcattttgatgtgcactccatatttgaaccgctcggcataaaaacatggattatcagcgcaaacggagccgccatccacgctcctgacggcagcctgtaccattgtgaagcgattgaagaaacaagagcccgggggattttgtcatggcttgaagagaatcaatattattatgaggtgtttacaaacaaagccatctatacgcctgaaaccggcaggcagctgctcgatatcgaaatggaccgggtgaaaagcgccaatccggaaaccgatctttccgttttggaacaggcggcttcagtgcaatacagccagtccggctttgcttacattcattcataccgtgagctctttgagaaagaagagcatctggatttttataatattctcggattttcgtttgatgagcggaagctgaaagcgggctgggaccgattcagcggtcagaaagatctcacccttgtcagctctgccgatcacaactttgaagtggcgtctcgaaacgcctcaaaagggcaggcgctcaaacggctggcgcaaaagctcggcattccgatggctgaaaccgccgcggtcggtgacagcttaaatgactattcaatgcttcaggcggccggaaaaggcatagcgatggggaatgcgagagaagatattaaagagatcgctgatgccgttacattgacaaatgatcaaaacggcgttgcgtatatgatcaggaatttactgtgaaaggtatggcgatactgttcatgactggcgtgacgcattcatggcaaatgcggcgtaacagtaaggacgacataaaagaccggctcttccgagagagccggtctttttgcgtttaatgtgattgcgtcgatgcgctgagggtgaataattcttcaagctcatcggatgacagctcggtaatccaattttcactttggataatctgatcgttcaaagtttgtttcgtttcgagcatggcatcaattttttcttcaatcgttcccgtcgtaatgagtttgtgaacgtggacgaaccgttcctggccgattcggtaggcgcggtcggtcgcctggttttccaccgccggattccaccacctgtcatagtgaatgacatgattggcagccgtcagattcaggccggttccgcccgctttcagtgacaaaatcagcgtcgggtattctttcttctggaaccgttcgacgagggaatcgcgttcctgcttggacaggcttccgtttaaaaactgaaccggttctccgaatgttttttccaggaggcgcttcatcatgttgcccatctgaatgtattgtgtgaaaatgaggcagctttccccttgtccgcggatcgccgccattaagtcaagcagcttttccagtttgacggatctcccgtttaacagctctgtctgttcttccttcaaatagagcgcaggatggtcgcatatttgcttcaagcggccgagcatgctcagaatcagcgctttccgctgcatcccggtcagagaagccatatgttcaaatgtatctttgacaagctgttcataaagggatgcctgttcggctgagagcgggataaactctttttgttccagcttgtcaggaagattaagcgccacttcttcatcccgttttgtccggcgcagtaaaaacggccggattaactgctgaagctggttgattcttttttcgtcacggtctttttcaatcggcagcacatagcgtttatgaaagccggtcagactgccgagatagcctttgttcataaaatcaaagatcgaccaaagctctgtcaggcggttttccatcggtgttccgctcagcgcgatatgatggacgcctttcagctttctgattgcgcgggactgcttcgtatgcgcgtttttaatgttttgcgcttcatcaaggcagacggtgctccatgtcacggaagaaagctcttcctgatcggcgtgcgagaggccgtaagaagtaagaacgacatccgcgtcctgataggccgggacaaatgcttcccccttcggcctgcgggggccgtaatgaagcacggccttcagctgcggcgcgaaggtctggagctcacgctgccagttgccgagcaccgatgtcggcgcaatgattaaggcaggcgctttttgccggccgctttccttcacatggagaaaataagcgatcatctgaatcgtctttccaagtcccatgtcatctgcgagacaggcgccgaagccgttttcccgtaaaaacagaagccagttcatgccgtacatctgataagggcggagctggccctgaaacgcggcgctgacttcatgctccggcagatccccggcatccgtcagtttgcggatcaggcttctgagatgctttgataattcgatcttgatcccggcaaatgccgatgagtcaatgatgtccgtgtcctcggctccgttttccccgtgatccatcagttcgcgcgccagcacgtcggacatgtggaggccctcagattccgctttttccatcagtattttcatctgtttaataaattgcggatcaattttcacccattggccgcggatgttgacgagacgtctgttgtttgcgacaagctcattgaattcatcctctgtcagctcaatcccgttcgtggcgaatctccagttgaaatcaagcagagcgttcatgccgacgaaggactcgccccgcggggaggatgacactttcgccttaagcatcatattgctgtcccggacaatctgccaccatgatgggagaagaatctccacacccatatcgacaagcgtctcactcgcttccgataagaagatccaagcctcttcttcagatatcagcgtcgttcctgaatcaaacgaaagccagggaaccgttctgcggaagcggtcctgttcacgcgcgatttttccgctgtatgcctgccacgcttttttcagccctttcagtccgtcgaaaaaggtgatggagccggtttttttctcacgtaaaaacatctcgattttccagtcgtcaccgtcgaaatcaggctcgtttaatcggaggccgacggtaaacggcgtcagatcgtcatgccagccgattccctccagaaaatcctcttcatccaaaaaggagcctttaaacgtatgaacggccggcgaacgggtttcgatccgccgccatttttccagcaggtcatcattgtactgaatgtagtcctgtaccgcggctgagaaccagtctgccgtaaagccttccagcaaaagctcgcggtctttgaagcgcaggaggccattttgccatgcgtcataatccggaagaaaatcgccgtcggcaataaattcgtatatcgtcgaagccgcttcgattaacggttccgtttcctttgtcagctgcacggtgctgaatgaattgaacgagttttttccaagcagctcgacggtcatccaagggctgagcagaacggccggagtgccgatgaagctgacgtcttcaagaaacgttccgtaaaaggtggactcatgccattggaacaaatgagtcttcatctgactgagagtaagcggctgctccttctcatcatggcttgacagcgtaaatgtccaatcttccatttgttctacatgaatgaaaatttccttaagactcgccatcaatcaactttcctttctgcaattcttcttgaagggcgcgcagcctcttgtagcttgcgctcagccggctgatataacgctcccatacctgctgtttttttgcctttttataaagcgtccgcagttttttcagatggcgcgcagcctctttataggcgctgcggtttttttggtcgataaaaaaggccgccgcccggtgataggaggggatgagcgcttccggatcactggcggcaatttccttcaggatgtccttttcaatttcccagacggaaaaaccgacgaggctgtgaatctccacccattccgcgtaccgccgtttttcgtacaggtactggctgtattcggtaaaggtatagggaaggcagccggaagcaaaccgttcaaacagctgatcatcccgtgagtgccgcgcataatccgccaacagcgcaaacagctctccgatgatgtcgcgcatttctttaaacggcttatcaagcttcgtatagttcacggcaagcggttcgatccggccataccatgttttcagccgtttccagtcttttttcgcggtgagttcaccgagccattgaaaagtgtacggcagcgcttcaggagggaagcgggacatatcttcaaagaccgcttcatcatctttttgcaaaaaggccagatgaagccgtccgaaccgcacttccggcgaaaaacggcgcccgctttcctgttcgagaatctcttgttcacgcgcgacccatttcggccggttcaaaagcgcgctccacatttcaccgaatacccggaggcgttcgtattgaaaaagctcttctttcacaagcagtctgcggagcaccgggggcgtccggtctaaaaaaggatcgagtgaaaaagacaaggcgtacgttttcagtctgtcaatggaggaataaatcgtatccatcagctgttccacgtatggattaatgctgtaataatctttttcggcatccaatctgcctgactcaatcaaagtgaacatgtgaagccagacggcaagcgccgaatgaatctgatataagcttttaagctcgggttttttcggggcgtgttttttgagcgctgacagatagccgtaataaaggccctgcatcgtctggcttccggccggcgtccgcgcctcccacagcgagaattccgaatcaaaaaaagcgagccagcttgacagcgactcttcattcggcagcactttttcctgaaactgccggcggacaagctccctgctttcctcaagcttttctctttccagccaatgttcggtaaaggtaccgacccgctcgaattgggcatatacgtaaagaaaaacggcgagcacgtggcggcagatcgcctcagacgggcatgcgcagccgcttttcaccatgaaaaataagttcagcgtgacccttacaggcacaacatcctgcacatatgcggaaatctctgtcggggtttgaacctgtatacgatagacggaatcctgccgatataaaatgagtgctttcttcatcagctgaacattgtcttcattgtaaggaagaagttctttaagctgttcagccgctgcgagcacatcttctttagcaatcatatcctgaagcatgattatcgctcctaacgagtcacaaaataaaaagattccaattcctctattatatcgcaacacatggcccggaaaaagtttttcctaaaaaaggacataaaaacccgaatgtgtcgaatgatgtattagagattgcaaaacagcacccgacagcatataataatcttgttttcaatttaatggaagccgaaaggaaacgaatgatgaagaaaacgaagttagatcaagaggagtttctgaagattttaatgcatgcgcacgacatcggtgagcagtcctctgagatgaccacaaaagaaatgcttgagaatttgatttcttatattaaaaatggatatgcaacataaaatcccgcagcctcctggccgcgggattttttaatcttcctgtgacaccagtatttaaagcgcttacaaatataatacagattgaagtgattgtctatttttgtcgaattttgtcatttgaaaaggttagaaatgacagtttaaagctgtataatcgtaattggaaaagatcattggagggaatgggaatacacggaaagtgatatggaggttatatgggagaatctgcaagcataaaggaaatattcgcaatactgagaaagcgtctgctgtttatacttattattaccgcggcggcatcttccgcaggcggtctcatcagtttcttcgctcttacgccggtctatgaaaactcaactcaaattttggtcagccaatccaaaaacaatcaaaaagaagtccaattcaatgacgttcaaaccaacctccaattaatcaacacgtataatgtcatcatcaaaagcccggtcatcctcgatgaggtgattaaacagctgcatctgtccatgacttcgaaagagctggaatcgaaaatcacggtatccagcgagcaggattcacaagtcgtgacgattgccgttcgggatacggatgctaagcgggcggccgttatggcaaatgcggttgcatccgtttttcaggacaagatcaccgccatcatgaacgtggataatgtcagcatcctttcaaaggccgaagtgtcggacagccagtcaccggcagagcctaaccgtaagctgaacatcgcgattgcgtttgccgccggacttttgggcggaatcggtctcgcctttttgctggaacatctggataatacgatcaaatcggaagaacagctggaagcgctgctcggcatcccgatcctgggaacggttacttcaatcagtactaaagacagcgttgccaaaagcttgaggatggcggaaaccaaacaagcgggaggcggacatgttgacgcgtaaaaaagacaaacccggaaaacgaagcgtgattgcgatgtctgagccgaaatccatcaactcagaacaatatcgcacgattcgcacaaacattgaattttcttccgttgatacggaggtgaagtcccttttgatcacatccgccggtccggaagaaggaaaatcgacaaccgcggccaaccttgccgtcgtatttgcacagcaggggaaaaaagtgcttttaattgatgcggatctgcgcaaaccgacggttcatttcaccttcaaattggataacggaaccggattaacgtcgctgctgttaaaacagatgccgtttcagaatgccgtcctgccggctgatgaagcaaacttggatattttaacgagcgggccgagcccgcccaatccggcggagcttttatcgacgggtgcgatgaaagatcttctgtcagaagcagccgcagtttatgataaggtgattttggatacgcctcccgttttggccgtagccgatacgaaaatattaggcagctacactgacggggccattatggtgatctcaagcgggaaaacggacaaagaaaaagcggccaaggcgaaagaagcgctcgattactgcccgtgcaagctccttggggccgttatgaacgggaagaaacaaacgaaacattcggactacgcctattacggacaataatgtcacaatgggcgcggtccattctttttaaggagggattgaaatatgatagatatccattgtcacatccttccttccatagacgacggcgcggcggatgatacagaaagcctgaagatggcgagagaagcggtcagacaggggattgatacgatcatcgcgacgccgcatcatgtgaaataccgctatgacacggatcggcatacggtcaacgaagcggtcagcctgttaaacaaacgtttgaataaggaaggcattccgctgactgttctgccaggccaggagatcagaatagacggagatctgctggcaggtcttcaaagcggctcgcttgccccgctccataatacaaagtatgtgctggcggaatttccggcggatcatgtcccggcctatgctgaaaggctgttttatgaactgcagctgaacggatatgtccccgtcatcgcccatccggagcggaacagggaaattcgcgaaaatccttccgtcctttacagtcttgtgaagaaaggggcggccgcccaagtgacggccggctgcattgccggagcattcgggcggaaagcgaaatccttttcgctgcagctgatggaagcgaatttgatccactttctcgcatctgacgcccataatctcggaccgagaaatttttattatcaggaggcgatcagcgttctgaaaaaagaagcaggggcggagctgatttacatgctcacggaaaatgcggcgcttctcgctgaaaacaaagccgtttataaggaacctccgctgcctgtggcccgccgtaagcgctggggtcttttttaatcgtcgtctccatcccgtttaaatgaagcgtaagcggctgttttgcaagatgattcttttatgcttatgctattatcagcggccggcgccgttttttcctatcatgacctcaggctcccggcattccgccggtgccgggatcatatgataatagcggtaagctgcccagcagcaatttctaaacggttgggggaacacgatgaaaataacagtgatcggaacaggctacgtcggtcttgtgacaggagtgtctctttcagaaatcggccatgacgtaacatgcatagatattgacgaacgtaaggttgagcagatgagaaagggattgtcccctatctttgaaccgggccttgaagatatgatgaaacgaaatatcggccggcatcggctggcatttgaaacgagctacgaaaaagggcttgcggaagcggacgttatttttatagcggtcggaacgccgcaaaaagaagacgggcacgcaaaccttacttatattgaaaatgtcgccgaacagattgccgaacatatttctaaagatgcgatcgtcgtgacaaaaagcacggttcccgtaggaacgaatgacagaatcagcgaagttattcattcacggctgagagcggacgtgaacatttcaatcgcttcgaatccggaatttctccgtgaaggttcggcgattcacgatacctttcacggcgaccgcatcgtgatcggggctgaagaccggcagacgcgggaaacgcttgaccgggttttcgcgccgcttgcgattccggtatatcatacggacatcagaagcgctgagatgatcaaatatgcgtcaaacgcatttttagcggcaaaaatcagttttattaatgaaatttctcatatatgtgaaaaagtcggtgcggatgtggaatcagtcgcacacggaatgggattggataaacggatcggcaatcaattcttaagagccggcatcggttacggcggttcctgttttccgaaggatacaaacgccctcgtgcagatcgcgggacatgtggagcatgattttgaattgctgaagtccgtcattaaagtcaacaataaccagcagtccatgctggttgataaagtgctgaacaggctgggcggtgtgacggggaaaaccatcgcgttattagggctgtcttttaagccgaatacagatgatatgcgggatgccccgtccattgtcattgcggatcgtctggcggctcttgacgcccggatgacagcgtacgatccgatcgcgtcattccgggcttccgggctgcttccgtctgcggtttcctatcgggagtccatagaagaagccgtcaggggagcggatgccgtcctgattctgacagattgggaacaaattaaacacttcccgcttgaagcgtacaaagagctgatggaaaccccggttattttcgacgggagaaactgccactcgcttgaggaagcggaacaggcgggcgtggaatatatctcaatcggaagaagagccgtcgtgcctcagactgattctgtcacttgaaaggccggcggtccgcgccggccttttatcatacaatcattagagacgaaggagatattaatcgtggaaaacacatggaaattgccgaagcaaatggaatcatcccgcggtctgctggaaacgtcagcacggccctttatcaaactgcacgtcaaaaaagctgaaacgggactgtatgacaataaaattgccggagacccctattttccgaaacatgaaccataccctgaagatgaaagcggcaggccgatgaagcttctcgcccaaatcaattttgcggatatgcccggactacctgattttccggacaccggcattcttcagttttacatatcggtcagtgatgacgtatacggtttgaattttgacgacgggtgcgcgcaaacgggtttctgcgtcaaatattttgagcacgtgacagatcgggaagaggagctcatggatgatttttctttcgttcaggttgaagaggagtacgattttccgattcaatccgaagcgctgatcacccctgagctgtctgctgaatgggcgctcccgtctgattttcaattcaggcaatatgccgggatggatgccttcgactatttcgagcagtttgacgatgaggtgtatgacgaatatacggtgaacgcattcggccataaaatcggcggctatgcgtccttcacccaggaagatccgcggtcttattcccatcaaaaccatacgattctgctcttgcaaattgattcagatgatgacattgattcgatgtggggagatgtgggaatcgccaatttctttatcagaccggaagatttgaagaaaaaagatttctcaaacgttttgtacaactgggactgcagttaacgacattattagaatcatgatacaaggcaaaggagacggttattcactgtctcttttttttagggaatttatcatggatacatagaggagatcaatgaatggatatgccgtttgtgtgagtcttttggcgttaatgatgagcatctcggctgctgaaaataagtcatttaacctatttaagctgctttctgtctattttaaaatataatatatggaaatatagtatggaaaagtctgtgctttttgtacgactttttgcgtaagacgaggtgaaaacagatgagccattcaagcacattaagccatattaacagcaccatcagccataaactgggcgagatcgaacaccaaattgataaattaaaagaagcgaaaagagagatagaatctctgcaggaagagggcgtgtctgaaatcagggacatcctcaggccgcacctggatcatcattggaccggcacttttgctgaagaatttgatgaccggcgcgatcaggcccatacagaagcatacagaatcgtcacagacaaatacgacggttatatttacagaatcggcttaaagatgacacagcttgaaattgaaaaaggagggctccttgccgccagaagcatcgcgagagaggcagagcacctgctgacgctgggagaagaagcccttgacacggtcggagaaaaaatacaatcaatcaaaaaaagctggagttggttttaatggcagaaataaaactcaaatacggagccgtcatgaagcagcttgaatccgtcagcagcgctttggaggccgtttctatcgggaacgccggtacaaacggaaaaaacaagctcgactatacctccaaataccaatcccgcgaggcaaagcttgtatcgatgatcagcgaatacaagcaggccgttcataagaacatagcggacgttaaagacaacgtagattctttgaaggaacaggacgaggcgatcgctgtaaaataacgaaagaaaggacttgccgatgagcaaagtgtttgaatcacaatcgttaacggacgaagcagataagagaaagaaacaatacgaagcccttgaagaacagctgcgtgcgctcaaacaagcctttcaaggcgtggccgatctgggtgatgctttgaaagggaaaggcgcagacaatataaaggatttctttcagggacaagcggaaatcgccgacagctggctgacgcttgtctctgctcaaattgcgtttttaaatggcatttcaggtgacattaaagatcaagagctcagtgattcatatgcggagacttcatttttagagcatgagctgcccaatgcggatttgagagcttcagagattgtctccgctcataaagcagaaatcgattcgattttgtctggcatcagtgatattattcatctcgatacatatacgctggatgattacgcagataaaatgggtgatgcccagaaaaccagacgcgacacgatcacggcagtcgatacgcttgatgaatccctgaccgctgaatatcaaaacttagaatctctggacaacgcagtgctcagcaaatattcccttctcatgcaggccaccagcaacgggaaaagcgcctcccctatgtactatgacaaaaaagccttccacagcaatgaaatctacaaaagcgtcatggcgacagaaaaacagggcacggactatattgacgcaaaagcccagcaggccgaagcaagacggcttcaggaaaaggctgaagaagaagccaataaaccatggtacgaaaaaacatgggacggcatctgcaactttaccggcgaagtcaccggctattatgattataaaagagcagccgaaggtgttgatccggtgaccggcgaaaaactctccaccgcagaacgcgtcacagcaggagcgatggccgccgccggattcataccggtcgtcggctgggcgggccgcgctttcaaaggcggaaaagccatttacaaaaccggaaaaaccgtcattgccgcagaacatgctttagatgcctataaaaccggaaaatccttagacattctcaaaatgacagaaatgggcgcatacggcctcgtcgcctcaaacggattcacagaagccgtcacaggacgggatatgttcggaaacaaagtgtctgaggaaaaacggaagcaaggggcgctggaagctgcgctgagtttggttggagccggtgcattggcgaagcatgtaaacaaaggcataccgcttgcaacccattcaaaagttcaaaaagctaacaagacactagaaaaagttaaacaattcaaagtcccgacaaacgtccgcgtgtacgcagaacgcccagtaacagcgaacggctttacgtacggattcccaacagtccgtgtcgatgtggaaaagacggctgttaaagaacttgggattgtgaagatggcgagtagccagtcaaaaaaaccaaaatggttggaaaaacctgaggggatgactcaaaatgattatgttgctcataatggtactaactacagtaaaaagaaacggactgaagaatacaatgctgcgctagctgataaagagaagatagttggagacaattcaaatggatatcgtttaaaagaaccaactaactggatggaagaaagaggtatgatacaaataaaagaaagattaaaaagaaaatcttggtcagatagagatgggtttaattggcaatgggattcccagcatggtaaattagaaaagtggaaccgcagaagaacagagcatttaggagagtttgatcctgtaactggtaagcagacgaaaaaaggcgagccttcaagaagatgggatggttaaaactatggaacatggaatcagatttattaatgaataccctgaaatcggtgaattgcttcatcgtctatttgtgaatagggaattagacgaatggtacaagagcaaatgcgcagagaaaataaaagtacctgatgaatttaatcaaataaaaggtttgaaaaaaattgaagttagagatttaaacaatccttcaggagaaattgatatccatttgcaagatctttctggggaaaatggttttcatttagaacagcaaatcaatatgaaagtatctaaattggttcctgtttatgtattagattatagttattccctaagacacgatttaatagatggcgcttatgacattgtaggaaccgctgaatctttagaattcattcagggaacgaactatattaataaaataatgcaagagaaagggtttatcgaactcagttatttgtatgattactacgatactgtgtatgagtggagtgaattgccacatatacagcctttcaacaggagattaacattaggagatgccttgtttactgatgtattagaattgctatagttaagagcttgccttgttgttatcggcaagtttttttataataatttaacaatgtggagtacaaggagaagcagttatggatagagaccatatttctcaattgctgccattaaaaatctgtaatggctggtctgtagtactgaacaatttaagttcagaaaaaagaatgcaagaaaaatatgaattactaaaactacaaaatgaaaaacgtaatgctgttattaaggtaatatttgaaaatgattaataccatgtcatagtagcgggcttaaaaacagataagatttataaagaagactcttttaatgaaatagaacaattattggaagagttggaatatcaaatctggactgtgggaagtggggttttagagggtttgcagcacctaagccaacatgttcccaatttcttaaggcttaagataccagcggggtggactgttgattatattccattaaaagatactgaccctaaaactctagaggaaaatgatgatgcttggttatttgactttaatcaagatctcctgcagtttctcataaaactaaaaatttgctgcttgtagggtggtacccagaaggggatccaaccggcagttatggcattgaactgataaaaaacaaagattgggaaaatcctttagaagatattatgtgtactgaacttaaagaattacttaaacaattggatcttatttttatgaaagaaatgaaaaatgaattttaataaaaagcagattatactatctgcttttttcaatgaagcatatggagtcttcgctagatcgaaacacaggacgattgagcgcgaagactattttaagagaggaaaacaagtgaaatgaaaatacatcaaattcacgattttgaacaaaaagatgaatcggattttattcgaactcaacaatctcttatacataaaatcaacctatcccccgtcatccatccagactccgtcaacaccagcgcaggcgtcgacctcgcttattgggagcaggacggggaaccgtacggggtgtgcagtatcatcgtgattgacgctgatacaacagaagtgattgaaaaagtgcacagcatggggaaaatcagcgtgccgtatgtgtccggttttcttgcgtttcgcgagctgccgctgatcatcgaagcggccaaaaagctggagacggagccggatgtgtttttgtttgatggcaacgggtatctgcattacaatcatatgggcgttgccacccatgcggctttttttctggggaagccgacgattgggattgcgaaaacctatctcaaaatcaaaggctgcgattttgagatgcctgaaaatgaagtaggcgcctacaccgatattctcattgacggcgaggtatatggctgggcgcttcggacacggcgggacgtgaagcctatcttcttgtcttgcggacataacattgatttagaaagcagctatcagatcacaatgaaaatgatcaatcgagaaagcaggctgccgatccctgtccgtctggctgaccttgaaacgcatgttttgcgaacgttttatcggaaaaatcacatgaaacacttggagctctaagccaccaagtgttttttttgtatgcctggtgtctgctttaaaaaaccttgtcgtccttgcagcaggtttttatttgaatgtttttcgcgtcaaatcgataaatgcctttaatggcgcagacatccacttgtccttatgccatgctagttgagtaaaaacggggcattcattctgccagttgagttctttcatccgtccttcggcaatatcgtcttttactgtcatttcaggcaatagtccgattccgagtccggccatcacgcattgtttgatggcttctatgctgacgaattctaatttattagggtagactccggcgtcatgtaaagtgttctcaaagagcgtgcgatatgaacagccgtcctctgtcagcagaagggtttcattttgaagatccttcaatgctgctggtgagtctgctggaaaaggatggtcattggcggctaccattttgatttcatcctgaatcagagattcaacgtgcagtgcgtcttccgaccgattcacatccaaaatgaaagtgatatcaagctggccctgcaagagctgttctttcgcttgttcgttggaaatatacggtttgaatataagctttacttgaggaaaagcctgtttgaattcttttatgataggcggaaggcggtatgtgcactggctttccgtcgcgccgattttcaaggttccggttgtttctcttgcttgatttgcggccatttttgcttcttctgttaacgcaatgatcttctccgcataggatttgaacgttttgccggcttctgtcaggaaaagccgcttgccgagccgttcaaataaaggagtcccgatttcttcttccagtgatttgatctgagaggtaacgcttgattgtgcatagttaagcatcttggcggttagggtgaagtttacgtgttctgctgcggtaataaaggtgatcagctgcttcaattccatttgatctcgccctttctaaatcggttttatcgattggaataatcgaaataatcatctgtattgattgatgaatccattatatgatgaagaaaatcattcgtaaacaaaggagcagatgcatcatgaacattgcggttattcatggcggaacgaggcctggcggaaatacggatattcttgcggagaaggctgttcaaggattcgatgcggagcacattcatttgcggaaatatcggatccggccaattgaagatctgcgtcacgcccaaggcggctttcgtcctgttcaagatgactacgattctatcattgagctgatattaccgtgtgatattcttgtattcgccaccccaatttattggtttggcatgtcagggacattaaagctgtttattgatcgctggtcacagacgctgagagatccgaggtttcctgattttaaacagcaaatgtcagcgaagcaggcatatgtaacagcagtgggcggagacaaccctaaactaaaagggctgccgctgattcagcaatttgaacatatttttcattttatggggatgtcctttaaaggctatgtgctgggagaaggcaatcgtccgggtgatattcttcatgatcaacaggcgctgtccgctgcgagccgtttattgaaaagaagtgatgcgatatgaagctgctgctggttatctctggtatgttgattcttgcactctttctagcttggaaagcgccgacttctgtttggatacaggctgaaaccaattcacctcaggttcagcaatctgtgagaatggcaggcgcaacgctgcaagtcaagcaaatcatcaagagtgatgcaggcgaagaaacagttgtcatatcaaatggtatttccgggccaaaataaaaaagcacctgtccaggtgcttttctttataaatgaggaatcacaagccctccatacaaaaacgccgcgataatcagaaaggccggatgcatcttgaattttgtcaagacaaggagggaaatccccgcaatcactatcgcttgaacccagccgatcgctttgatgccgtctgcgccgatttgccaggtaagaatgagcatcatgacggcgatgacaggctggacggacagcgtcatacctttgatgacgggggattggcggaagcgctgaatgacgcgcaagaggatgatcaatgcgagcgccgacggtacgacggtggcgatcagcgcaatcaggaatccgggccatccgcctgcgctgtagccgacatacgccgcgattttggttgcgatcgggcccggcaatgcgttcgcaagtgcgagcatatttgagaattgatcgtttgagagccagctgtatctgttgacgacttcttcaaacatcagcggaatcgacgccggtccgcctccatatccgagtacgtttgcgacaagaaacgccataaatacataaatcaagatcatgaggccggcattcctttatcttttgaacgtttctttgtgattttgtcctttaatttaaaatgaaacgcgccgtatgccaagaaaatgataatgacaaagccgggattgatctgtaacgtttgcaggccgataaaagcgatgataaaaaacaggatgcccgtgacccagccgaaacctttaagcgctttttggccaaactcgtacgccatgatgccgagcatgacggcgatcaccggtgttacggcgccaatcatgccggcaacgattgctgagcggcttaagacattgacagccgcaaacaagcccgccatagcgagacatgtaggcagaatatgtgcgagggttgccgcgattgcgcctaacgtgcctttcagcttgaagcccagatacgcagccatttttgtggcaatcggtccgggaagcgcattagcgatcgctaatatttctccgaattcatcatcatctatccatttgtatttattgacggcttcatggcggatgagcgggatcaccgacgggccgcctccgaatccgagaatgcccgttcggaccatcgccgccgtaatgtcccaatagggatgtttcatggctatgtcctccttacagcttcatgcccgttctgcttttataccgtttaatcagcatttggcagtcgacgctgacgacgcctttttgcgtatagagccgttttgtcaaaaactcttccatctcctgatcatttgcgaaaatgccgtgcatatgcagcttgctcggtccggtcatatgataaaggcttgtcaccgccggctccttttcaagctttaatgcggtttcctccaaatactgcggctccacctccacgttaaaaaacacggacacatgacggccgattttcgccgggttgatgacagcggtgaatttttcaatcacaccggcatccagtaaatgctgaatgcggtgctgaaccgccactcgcgacaggttaacccgctttcctaagtctgtataggaaatcctcccttcctcgtgcaaaatcgagagaatctgtttatccgtttcatcaaggacaagattcggaatgctgtactcatgttccaaccggcttcaccttccttcatttggtggatattattgtatcatgaaatgttacggtatgaaggggaaatttttttattgttttcgttacgtaataacttaggattatttcttatcggaaagtaaatagtgtgtgagcttttctttcaggaaggtggataccggtgaagccgctttttatacttaggaaaatttgtaaaggggcttgccatgaatacttcaaccatcggaacgaaacaaatggtcgtcagtccgcattatcttgcttctcaggcggggccggcattctggaaaagggaggaaacgcgtttgacgcggcagtggcggtcagcgcctgcctggcagtcgtgtatccgcatatgacgggtcttggcggggattcattttggctcacttaccataaagaaacgggacgaatcaaagcttataacgggagcggccgttcagggaagcatgtgacgagagacttgtatcggggcagagaagcgatccctctgcgcgggccagaaagcgccattaccgttccgggaatggcggacagctgggatgccgtgctttcggcgtacgggcgtctttcgctcgctgaggtgctgaagcctgctcttgattatgcggcaaacggattcccggtgtccgccgaccagtgcgcccacacagaacgcaatctcgctcttttagcctcgatgccttacacctcggccatttttacgagaaacaaaaaagcgcccatgcccggtgaacggtttgtccagaagaatctggcggccagcttggaacagcttgccgagaaaggcagaagcgctttttatgaaggagatctcgctcaaagcatcacatcctttctgcaaaacaacggcagccgtctgacacttgatgactttaaagcccaccgcggcgagtggacgaacccggtatcctctgattaccgcggataccgcatctatcaggctccgccgaattcacagggctttacaggcttaatgacgctcaatatattggaaaactatgatttttctcagattgaacacggctcctttgactattatcatctgctgatcgaggcgctgaagaagagttttcagcaccggaatgaagtgctgactgatccggcattttctcatattccgctggatcggctgcttgataaacggtatgcaaagcagctggcggaagaaatcggtgacacggctgcgccggcgctaagccgtccggtcggaagcgacactgcttatgccgccgtcagagatgcggaaggaaatgccgtttcctttatacagagcctttattttgaattcgggtcagccgttacggcgggggagacgggcattctgctgcaaaaccgcgggtcatttttttcgctggatgaatcccatgtcaatacacttgaacccggcaagcggacgttccacaccctcatgccggcgatggcctgtaaagaaggaaagccgcacatcctgtacggaacccagggaggagaaggccagccgcaaactcagacagcgatgattacgcgcatcattgattacaaaatggacccgcagcaggcgatcaatgagccgcgctgggtctgggggcggacatggggagaggagtatgaagggctgagggttgaaagcagaatcagccctgaaacgagagaagccttaaggcagagcggccaccgcgtcgagaccgttggtgattttgacgggcttatgggccatgcggcagcgatcgtcattgatgaagaaggctttctccaaggcggggccgacccgcgcggcgacggagcggccgcaggagtatagagcatgatacgctaactgatgaaaaaaataagcacgccaagagcggcagaaagacctgcgtaaaacgaatcgtacacatattgcttttcctcccgccggtgccgccattccattaagccgctgcagcaaaatagcatgaaaacaactcccgcaaatacgtacatttcattgaacaaagtcaccgctgcgatgcccgtaataagcagtgtgatttcgattaatcgatgtgtgccgtttatcggcttctgctttttaacagcctttggaaaatgaagaactttgacggcaaatacttgaaacataaggctgagcaaaataaatacggctgaaaaaatcagtaactgaatgaaatccatcgtctcctcctaaaaatgtcactcgtttcatatgggtgagggccttgtaagtttcagcattctataagacattaggctgagtttaatggtaaaagactcaaaaaagacccctttcgaaaggggtctttttgactagtttcttctattataatggttcctgcttcaggtcgggcggacaagcgtatatgtcttcccgagtctgacgtattcattccccgcgagccttgccgcaggcttcagctcatctgtccgtatgtagcctttatcggcgtcatatacttggtcattcaaatgaaaacaaacgactctgccgatgatgaggtctgtcgtcgtttctccgctgtcattttgaaacggaagatggcgttcgagtatacattcaaacctgacttttgcttcttttataccgggaacgctgatgcaggcgctgtctgtcacagaaaggtctgtcatgccaagttcactgacatcaggatcaagccttgccgccgttttgttaatgtcttcaataatggactcatcactgacgtgcaccacgaattcccgatgagcgattgcgtttctcgcggtgtctttctgccgtccgtccgcgcggctgacagagatggccagaagcggcggttctgcggagacaacgttatagaaactgaagggcgccgcgtttacggcgccgttgatggatgaccgcgtcgtgacaaatgcgatcggccggggaacgactgtgcccgaaagcaatttgtaggtgtcttttgcgttcagttcgtctgctcgtaagatatgcatgatttcggccgcctttctttatcgtatgacctgattatacagaaagaaaattcggaaacacaacaaaagaaaaccggctgcatatcttatcacgtggcatatatctgattgaggaaaaaggcttccgtttagccggcagcctatttacaaatggcgttacttgtagtttttctttacaacccagatgttcccgtctttccagtactctgttttgctgcagtaatcgtcttttttgcaagggtcttttttatgaggacggtaaggttttttctgcgtgcgttttttcttgcggcggcatgattttttgtggctgcgagattttttgtgagaacgggattttttatgactgcgagattttttgtgagagcggcgcgattttttatggctgcgagattttttgtgagaacgggattttttatgactgcgagattttttgtgagaacgggattttttatggctgcgagattttttgtgagagcggcacgattttttatggctgcgagattttttgtgagagcggcacgattttttatgactgcgagattttttgtgagaacgggattttttatggctgcgagattttctcttcttactgctttttggttcttggtacaaataatcttccaatccctcggtgcttgcggactttactgcttcttcgatatcagaatgggaatagtggcccattttgaaacctcctcatgatatatgttttaaggatgcgatccttactaccacatagtacgcatgaatgaaaaaagtgtatgtgtgattcgctgagttttatataaatagcacagcctaaattaatacagggagggttactgatgaaagaccaatcaacattgcctctataccagctgtttattcacccgaaagacttaatggagctgaaaaaagacatttgggatgatgatccggtgcccgcggtgctgagagtgaatcaaaaacggcttgacattgatctggcgtaccgcggctctcatataagagattttaagaaaaaatcgtatcacatcgctttttattcgccgaaaacatttcgcagggcgaaagagatacatttaaacgctgaatacaaagatccgtcgatgatgcggaataagctgtctctcgatttcttcgcggagcttgggacgctgtcaccaaaggcgaatttcgtaaccctgcaaatcaatggcagacatgagggggtgtatcttgagctggagtcagtggatgaatattttctggcgaaacggaatttggcggacggggctgttttttacgcggttgatgacgacgccaatttctcccttgtcagtgatctggagcgggatacgaaaacatcgctcgaacttggttatgaaaagaaaacgggaacgaaagaagacgatttatacttgcaggacatgatctataaaattaataccgttccgaagtcagagttcaagggggagatcgtcaaacacttggacgccgataagtatttgcggtggcttgcgggcatcgtgtttacctcaaactacgatggatttgttcataattacgctttgtaccggaatcatgaaacgggactttttgaagtcattccgtgggattacgatgcgacgtggggaagagacattcacggtgatcggatggaggccgattatgtcagaatacaagggtttaataccttgactgcaaggcttctggatgaaccgtatttccgcaaagcgtacaaacagcttttggaagaaacgcttcagacccggtttaccattgaacatatgaagccgaaggtcatgtcactgtatgagcagatcaggccgcatgtcgcaaaggatccttataagaaagaggagattgattgctttgaccgggagcctgatgtgatttgcgaatacattaaggagcggtccgccttcatcagcagtgagttagagcggtggaatatctgatttggaaatgaagaaagattttttacaaataggctggtgaatcagttcccgaaaataatcgtgatacgtatatatgcattatgctttttacattatgagaaaaatgactaggaggacaatagatgaaacgcaatacgaagcggcatcggtctgatgacaactttttgcatgcgatggaaggaaaagtaattactgtctaccggggaggcccggagtccaagacagggagattagcagacattcaatcggattatatcgctcttcaagttgataataaaatcgtttattatcaatggaaacacgtgaaaagtgtgacggaaaatacgagtgaaaccgtatcgccggccgaagcggcagaatgtgaaaaagctgatgattttcaagatctgatcagccggatgaccaatcgcacggtgcaattgaatcagggaggtccggaatcgaaaagaggaaagcttcacgaaacaggggatgattttctcgtgctggaaacagaagatgacggaatcgtatattttaacgccgatcatgtcaaaagcatcagcgcggaacaagaagaggacggccaggaggaggagcgcccggaatttgaaatggctgatgattttcacggcatatttaaacgcctgatccacaaatgggtatccatcaaccgcggaggtcctgaagccgttgaaggtatacttgtggataattccgacggccactacactcttgtgaaagataaagaagtgctgcggatctatccttttcatatcaagagcatcagcgaaggggcaaaaggagcagccaaaaaagaggagaataaagacgacgagaataaaggcgggaaagagagcgccgaagaagaaaagtcacatgaagaagaatctcgcgaagagcagcgtacttcctctaaaaagtcgaaaagatcgtcaagatccgttcgatcctcaaaacgggaggaagagaactcttatagctacgccactgtattaaggacaatagattataggtggaaacacggccgtaaatgattggaaagattgtccgtaaacgcgggagaggggggaatgaaatggctggattaagcagatttcttgataaacaagtcgatattgagatatcggggaatacgacattttcaggaactcttttggatatcggtcaggatatcattgtgattcatgacggccggacgtttctttatattccgctgctgcatcttcagaggatgacattgacgctcccggacgaagagaataaagaaccgtacgcaagaaaaaaaagtccgcatcccgaaaaacaggaacattccttttcttaccggaataccctccagcatataaaaggcagatttacagaaattttcgttacgggagaccgttccattcatgggtatgtgacaagtgttttaaatgattattttgttttcttctctccggtttataagactcttttcatctcgatgcatcatttgaaatggctgacaccctattccgatgagcagacgccgtatacattaaacagttcagagctgccggttgttcccgctaatgtgccccttgtccggaattttgaggagcaattaaaaagatatgtcgggaagctgattattctggatttaggagatataccgaataaagtggggctgttacaggacgtctcagataatattcttgaattgaccaatgcagacggggatactgtcttttggaaattgaatcatttaaaaaccatgcacctgccataaatgataaaactgcctctcttatacagcaggcagttttttttcatagctaaaggtaaatccagctgatccaaacatataaaacggtaatggtaaacacgacggtgagagggacaacgacaatggtcgttttgatatattctgaccaagaaactttttcgccgtgctgtctgatgatatgcatccagatcagtgtggctaatgtcccgatcggcagaagcaatgatccgatatcactgccgataatattagccagataaatgatttttacggttaatgggtcgatggacatttcagttaatgtcaaagtgctgatcattaaggcgggatggttattgaacaaattagagaggacggatgtagcaatgcccataatagatgcagcgtgggcaatgctttgtgagacataaggctcaatagactgaacaagcaatgccgtcagtccgatattatgcagtccgtaaatgataatgtacatcgtgaaggcaaaaataaagatatgccaaggcgctttccttaataagtccgccggtccgatttttaaataaaaccatctccagcaaagcaggatgactgaactgatgacagccacgagcgaaacggatatgccgttgtaagaagctgcaaacagactgatccggacaaacaatacaaataccaaaacacaaaacatgatgttcgtacggctgtttttttgggacaagtctggcggaggctgaagcggatgatatcgtttgtgttccagcgattcaaaatgaaccggaatatcggggagctgtttcggcaaacggcggtagaaaacggcaaacagcagaaaggccataaacaccagtcccagcgtgccggggataaacatcatattggtgtacaaataaaggtccatgcctatcattttgagagaaattaaattgacgatattactgacgccgatcggggtgcttgccgccgtcgcaattaatacgccgcttattaaatacggtgttttctgatgtcttttaagtccgagatattgtaagaccaatagtaaaataggagtggtgattaagacgctgccgtcattattcagaaagagcgtcattgaaaaacagagcaggttggtcagccaaaaaagccggatgcctgatcccttggcgcggtgaagcagtttggccgccgcccagttaaaaaaaccgaagctttccagcgcgatcgccattatcattgtggagataatggttattgatgctccggtgacttttgaccctatatcccccaaatcatgaaaggaaacggttccgcataacaaaacgagaatggcgcccagcgacgccggaacggcttcatttaatcccccgggtctccaaaatataaaaataatggtcacaaagaaagaaatcagggtcaaaatgacggtaatatgtgtaatgtgttctgcctccttttcgatgggtcattgccgccccgttatttttatccctcctgatcagttgtactgtatgtatacgggtacaggtcgtaaggtgtactgagcgtttctaccaatttagtaaaaatccataaaagcacaaaaaaaagaggctgctttcggcggccctcttttttatgcattttccttatccgcctgcaataaagcctggcgcttattcataatatccagaaaatgtttcaggatcggattttgattatccttgcggtaggcaatgacccattcggcagtgagctgcgcctgattaatgccgcggtaggcgacttcgagattaaacagctttttagcagaagaaggcacgaaggttacaccgataccggcactaaccaatccgatcaccatttgatactccgtcgcttcctgaacgattttcggtttgaagcccgcctgctcgcagtagtttacaaactccaggtataaagtcggccatgtttctttcgacagtgtgataatcggttcattttttaaatcctgaatgtcgattgtctgtttagcggtaagcgggtgctgcttcggcaaagccagaatgcacgggctgctctgcaccttttccatatgtaacgcggaatgttgtaaaggcggatgaaggatgccgatatcaatgttccccttcagaagttcttcctgctgtctgaaagaagaaatttcacgcagatcaagcttgacggaggggaatttttcgcggaattcccgaatgatcggcggcagaaattcatatgtggccgagccgacaaaaccgacgacaaggcggccgagctctccccgcgccgttctctgcgccatttcaatcgctttgtctatttcttcgatcgcgtttctgctgtgttttaaaaaactttctccggcagctgaaagctctacaacccgtttcgtgcgctttaataaggtcacgccgacttccttctcaagctgtttgatctgctggctgagaggcggctgtgtcatatttaaccgaagcgcagctttgccgaaatgaagttcttcggcaacggcaataaagtattgaagatggcgaagctccatccttatccattcctttctctttgttaattattcgtgaaacatattaatcatacggcgaattgatattggaggtcaatttccaaagagtgtatagtgaataatatcacaaattacttaaaattttatatttaatatgcataataaggagtgagggtgttggcaaaagcaacaaatgaactaaaaacctctgaaaaaaatcggggggcggagcttgttgttgattgcttagtggagcaaggtgtcacacatgtttttggcattccgggtgcaaaaattgatgcagtatttgatgcgttaaaagataaaggacctgaactggttttatgccgtcacgaacagaacgctgcatttatggctgcggctgtcggaagactgactggaaaaccaggcgtttgtctcgttacttcaggcccgggggcatccaacttggcgaccggcttgttaacggctaatacagaaggtgatccggtagtggcgctggcgggtaacgtaattcgcgcagaccggttaaaacggacacaccaatcattggacaatgcggcgctatttcagccgattacaaaatacagtgtagaagtacaggaaacagggaatataccagaagcggtaacaaacgccttcagggcagcgtcagcaggtcaggcaggcgcggcttttgtgagctttccgcaggatgttgtgaatgaaatcacaaatgtgaaaaacgtacgcagcgtgccggcgccgaaacaaggccctgcaccggaagaggcggtcagcgcggctatcgcgaaaatccagacggcgaaacttcccgttctgttagtcggtatgaaaggcggaagaccggaagcggtaaaacaaatccgcaaactgcttgccaaaacaaaactgcctttcgtagaaacgtaccaaggggccggcacattgtccagagagctggaagaccaatatttcggccggatcggactgttccgcaaccagccgggcgatcttctgcttgaacaggcggatgtcgtattaacgatcggttatgatccgattgaatacgatccgaagttctggaacgtaaacggtgaccgtgctattatccatcttgacgaaatccaggccgatatcgatcatgcctatcagccggaattagaattattaggcgatatccccgctacggttaaacaaattgaacacgacgctgtgacatttgatatgggcagccgtgaaaaagaagtgctgagcgagttaaaacagatgctcacagacagcgagaaggcgccaagcgatcataaatccgacagagtgcatcctctgcaaatcgtccaagaactgcgcaatgcaattgatgacgacgtaaccgtcacttgcgatatcggttctcacgcgatctggatgtcccgctacttccgcgcttatgagccgctgaaactgttgatcagcaacggcatgcagacattgggcgtagcgcttccttgggcgattgccgccacattggtgaatccgggtgaaaaagtcgtatccgtttcaggagacggaggattcctgttctctgcaatggaattggaaacggcagtccgcttaaaagcgccgatcgttcaccttgtatggaatgacagcacatatgatatggtcgcattccagcaaatgaaaaaatataaccgtacatcatgcgtagatttcggaaacattgacatcgtaaaatatgcagaaagcttcggcgccaccggcttgcgcgttgagtcaccggaacagctggcagacgtgctgcaaaaaggcttgaacacagaaggccctgtcatcattgacattcctgtcgattacagtgacaatgtccatttatcaagcgacatgcttccgaagcaattcaaagaaaaaatgaaagcaaaagctctctagcactctgcgcaccatgacctgttttctaaaacagcccaatttaaaaggagtgaagggaatatgaaaaacgcaagcgacatccatatgatgagccgcggagaaaaaggctcacctgaggatcaaatctatcaagtatccaccatgacatctctgctggacggagtgtatgacggagattttgatatggctgacattccgaagttcggtgatttcgggatcggcacgttcaataaactggacggcgaattaatcggatttgacggcgaattttaccgtctgcgcggcgacggaacggctacgcctgttaaaggcggagacctgtcaccattctgctcattcacatttttcacgccggacatgacgcatacgatcgacggcgaaatgacccgtgaagaattcgagcaggaaatcgccagccttctgcctagtaaaaacttattttatgcgatccgtttagacggcgtatttaaaaaggtgcagacaagaacggtagaacgccaggagaaaccgtacgttccgatgattgaagcggtgaaaacacagcctgtgttcaactttgacgacattcagggtacaatcgccggcttctggacgccgggttacgcaaacggcatcgctgtttccggatatcacctgcacttcattgatgaaggacgcaattccgggggacacgtgtttgactatgtcattaaagattgtaaagtgaccatttctcaaaaaatgaatatgaacctcaagcttccgaatacggcggactttttcaacgcaaatttagataatccgaattttgcgaaggatattgaaacaaccgaaggaagcccggaataaaataaaaaagaaagcctcatttttctcgggggctttctttttatttggctgaaccggcaaagattaggtaaaatacagtcaaaagggaaaggtgtggtagctgtgaaagtattggtattagcggttcatcctgacatggacaactcagcggtcaataaggcgtggacagaagaattaaaaaatcatgatgacatcacggttcgtgagctttataaagaatatccggacgggaaaatagatggggaaaaggaacggcagctgtgtgaacagtatgaccggatcgtatttcaattcccgctgtactggtacagtgcgcctccgcttttaaaaacatggatggatcatgtgctggcgtatggctgggcttacggttccaaaggaaaggcgctgcacggcaaagaattgctgctggctgtttctgtaggtgccggagaggatgcatatcaggcaggcgggtccaaccatttttcactgagcgagctcttaaggccgtttcaggcaatggctaattttacgggaatgacctatttgccggctttcgcgatgtacggggttagcagcgccgatgctgcggctatccgtgacaacgccaaacgcctggcggattacataaagaagccattttagagtcgtatgcattcatcttcatccgacaatatttcctgagaaatatttcgaaccttagacgtttctgactgctcaagaaagaaaaaacggatttcgcgctgaatttgcgaaatccgttttgatattatgtcagtttttgcagatcttttgtgctgatatatcccgttgcgcccccgtaatcgacaagcgcccagccgaaatcaatgccgccgccggctgtctttttccatccgaggaaagaaacgctcgtgtttttggcaagggaagctgtgaccgcttgtttgtctgtatatacttttgtttttgccgtcgtttttacggttgttgcttctttaacaatataatgagtagatacaaatcctgtttttccgtttttataatgtacttttgcccagtcagcgttctggaatgaaacgatctttaagctgtcgcctaaatgaagggtatcagctctcggactggctgctgatgcttttgttctcacgttcaatgcttccgcggaaacgagataagagtcaagcgggtagctgtacagatcgtcaattttgaccgcttcttgcgcgtgtgtctcgggaagaggcgttattccggcagctgaagccgctgatattcccgctgcaagggtcagaatggatgccgctttggctgttttcttcatctgtatctctccttttacttcatcctttcacgttttaccggaagtctaaacatcagccggttatttttgcgtttgaagtttcaatggagcggaaatggtttttttgactttttttcctttgagcacctgctccgccgcttcggccgccagttttccgatcagctccggctgctgggcgaccgtggctgtcagcttcccgcttttaatggaagaaatcgcatctttatttccgtcgaaaccgacgaccaaaatgtgtttgcccgagctgttaatcgcttcgagcgccccgagtgccatttcatcattatgggcgaacacggctttgatatccgggtgtccctgcagcaggttttccatgacggtcaatccttttgtgcggtcaaaatctgccgcttgctttgttacgacatccagctttttgtcggcaatatgatgaaagcccgttccgcgttcccgtgtcgcggatgcgcccggcaccccttgcaattcagccactttggcgccttttccgagctgatcggcgaggtagtcagccgccatttctcctcctttgacattgtcagaggcgacaagcgtttcgactttgccgtgttcggctgaacgatccagcgcaatgacgggaatgccgagggaatttgccgattcgactgctgttgaaatcgctgatgaatcggtcggattgatcagcagcgcatcgactccctgctggatcaaatcttctacgtcatttgactgtttagatgaatcattttgggcatcgacaataatgaccttcatgccccgttttttggcttcctttacaacgccttcttttaatgaaacgaagaacggattgtttaatgtggagacggagagcccgatagtgaattcttttttatgttttgtgtttgacggttttgcccattgcggcggttcaagtgaacaggcggacagcaaaaacagtgataatgccgcgatcgtgatgatggctttcttcataatggtcctcctactatgccgattttttgcggtccagcagcaccgcgattaaaatgacgattcctttgacgacgagctgataaaacgatgatacgccgagaaggttcaagccgttgttcagcgtaccgataatcaaaaccccgatcagcgtaccgatgatgcgccctcgaccgccggacaggctcgttccgccgagaacgaccgctgcgatggcgtccagctcgtatgattctccggccgtcggctgtgcggaatttaagcgtgatgtcagaatcgctcccgccagcgccgataataaacctgtcagagaatagatcatgatcttgatgcggggcactttgattcccgatatcagcgccgctttctcattgccgccgatggcgtatgtccggcggccgaacggtgttttgtgcagaagaacccacagggccgcaaatgcaatcagcatcgtaatggcaggtacggggatgccgagaaaataaccgcgcccgaataattgaaatgcgtaatttgaaccgagccccgtaatcggatttccgtccgtatagacgagggtcagtccgcgaaagacggtcattgtcgccaaagtggcgatgaacggcgccatttttccttttgtgattaataatccgtttatcatgccgagtacggcgccgatcacgcagccgatgatgacggctaagatcgggtcgatgcctgagaccatcatacctgcgaccactgcgctcgataaggcgaggatggctccgacagagagatcaatgcctcccgttaaaatgacaaacgtcattccgaatgcaatcagagcgttaatcgcaacctgccgaagaagattgagaatattgagaggttcaagaaaactcgggtttaaaacggaaacgatcagcacaagaatcagtaagccgagaaacggaccgagtttttgcgtgaaggtatgaatggaaaatcgcttttgttcagttgatgttattggttcagttttcatactgctgccctcccgtggcaagtgtcatgatgtgttcttgtgttgcatctgccgcattgatttctccgctgatgcgcccttcgtggacgacgatgattctgtcactcatgccgagaatttccggcagctcggaagacaccatgatgatggcgactccgcgatcggtcagttcattcattaatgaatagatttcccttttcgcgcctacgtcgacgcctcttgtcggttcatcaaggatgaggactttcgggccgattccgatccatttggcgatgacgactttttgctgatttcctcctgataaatgccgggcggcggtttccggagatgcagtcttaatggtcagacgcttgatgagcagctcaacgaactccgcctcgcgttttcggtcaatgatgcctttcggagagaagctggtcaggttcggcaatgagatattttcacgaatggacgtatccagcagcagcccttcatctttgcggttctccgtaatcaggccgagtcccttgcggatggcatcgtacggaccccgaatgccggtttttcggccggaaatccagacctctccggaatcgagccggtcaattccgaacagcgccctcatgatttctgtccgtccggcacccattaagccggaaacgccgaggatttctccggcgctcacatggaaactgatctgtgaaaatcttcctttttttgaggcgtttttcacttcgagcaccttatcgccgagtgacggcgtgcgggtcggataccgatcggtcagctcccgcccgaccatttttttgaccacttcatcaaaatgagtatctttcatatgcgccgtatcgacagtgaggccgtcccgcataatggtgatccggtcgcaaattgaaaatatctcttccattcggtgagaaatatagacaatggatacgccgtcccgctttaacgccgtcatcacgtcaaacagtttgctgatttcccgttcggtcagcgccgcggtcggttcgtccataataatgacttcggcgtttgtcatcagcgctttggcaatctcaatcatttgctgctggccgacggaacattgtccggcttcccggtcaagaggaagagagactcccagtttttcaagctgtgattttgctagcgctttcattttcttcgtttccaaaacgccgaacgccgtcgtcagctctttgccgataaaaagattttcaagcaccgtcatgtccggccatatattcagttcctgatggataaaggcgattccgtgcttttcggcttcctttggattggagaaattcatatttgttccgtttatcgtaatgtttcccttgtcgagccggtagagcccggtgagcagattcattaacgtcgatttgcccgctccgttttctcccattaaagcgtggatttctcccggcagaagctcaaatgagacgccggatagcacttggtttttgccgaatgctttatgaatgtctgtcatgccgatgtgcatgctggatcccttctttctagaaaatcacacccgcctgcaggatgcagttggcgtatggtgtcatttcacccgtccggatgacggcttttgctttctgtgtgagccgtttgaattccgagtgggacatgtactcgatcgtctgcgctgagaaatggctttctatgaaacttgcattctcaggattttcgtctttgatctcggaggcggccatcaccttttcgacggccatctccccggctaccaggctggtcacatcccgaaaggcgggaatgcccgccgttaaggacaaatcaattttagggacgccgtcagggacggggagacccgcatcggcgatcgcgatgaggtctgtatgcccgagatcggctaatactttggcaatgtggctgtttaacattccgtgttttttcatgacagcagctcctcaacttcttttctgaccggcatcccgccttgggcgccgaagtgctgcacggacagggaggcggcgcggttggcgaacaggagcgcttgctcgatgtcccgtccttccgcgagcgcgacggcaagtgccgcattaaaggtatcgccggcacccgtcgtgtcgaccgcttctgcagggaagccgggaacaagccgttccgcggtgccgtctgagtagcgtacgccttgttttccttcggtaatgaacagtttgccgggatagccggcgagcgcttcttctttcgtccggtcaggaaataaaatggatgcttcatgttcgttcggcgtaagatatgcggcattctcaatcgtcgattgtttcagcgggcgggccggcgcgggattcaggataaccggaatttggtgcgcgcggcagtagctgcacacttcttcaacagtttcttcaggaatctcctgctggatcagcacgatatcaatgccgggaagtttttccagcgcacttttggcataatcgggtgagatgtcatcgtttgcgccttttacgacgacgatgctgttgtctccttctgcgagcacaatatgagccgttccgctttttttatgtgtaaccgtttccatatagtccgtattgacaccgtttgccttcaggttttcaataatcgcttttccgtagctgtcactgccagcttttcctaccatatatacgtttgcgcccagacgggaagcggctacggcctggtttgcgccttttcccccgggcacggtttgaaagtctgtgcccagtacggtttctccggctttcggacgccgttcggatgtgacgaccagatccatagaacagcttccgataacacaaatttcactcatggtgatcatcctttctcgtcgtttgtcttcttatataagtcacgggcagttgaatggccgtctctttcggcggctctttctttatcaattgcagcagcaggtttgccgcttgttttcccatctcatatgcaggctggcggatggttgaaagcggcggaaacaaaagcctgctctgcggaatatcgtcgtatccgatgatctgaatctcctccggaacttttttgccgagccgcagcgcctcatggaggacggcagccgccgcaatatcgttgctggcaatgactccgtcggtttcggggtatgctgcaaacaatttttctgctaaaacggcggcatccttgatagaaaatgaagcggcggagatgacattgaactgcgcgcccgctttatacagcacatcaagtgcgccgttaaaacgttcctgagcggtcggaaggtggcctgggcctttgacaagcgtgatgcttgtgcttttgccgcgaagcatttcctcagccgcccgttttccgcctgcccgcccgtcactgaatacggatggggcgccttcttttgtccggtccagaaatacgaccgggtaaaggctgccgctgtattcgggaaggtcggggtaatgggtggccgccaaaataccggcaacttgattttgtttaaatgtttgcaggtagtcgagttctttttccaattcttcatcgctgttgccgatgatcagccggtatccttcccgctgcagctcgtcttcagcgccgcgggcaagctgcgggaaaaaggggttcgtaatatccggaagcaaaagcccgaccagtctggattctcttttataaagagagcgggcaacttcattcggataataattcagcttctccatggcaagcatgaccttcgttcgtgtatcttcatggacgtagccgttgtcattgaggacacgcgagaccgtggcaacagagacgccggcagcgcctgcgacatctttaatcgttaccaacaaacactcccccttcatttatgtaaccgtttacacaaaaagagtaccacgaatcatttcggttggcaacaaaaaaagagaccggggtctcttttagttcacgatgccgatttgcgagatattcactttgatatcagggattatctcgatggaaggatagacctcacgccaattgagccgcttgccccgctcataataatgggtttgatatttccggccgatgccgaggatatccgagttgtgctcctgaatatggctgatcaccgatctggcctggctgttcaaatttgctgatgcttgtttgttcatttggtcgattgccgtataagaattcagtttgtccttcggatattccaagacgcgtgcattcagctttaaacggattttcacttttatatgctgcggatctgtatctataaatacaatctttcgcgtggcatccgtgatgccgagagaaagataattttcaatatccattttgtatttgtcccacagcttcagattaatattagccgatttattaaattgcccgcttaaaagggtcaggagggtcgaatcctgaccgagcacctcagtcactttccgctgtccgctgaacagggcagaaccctctacctttatcgtctgtccgttaatcgataaataaggaagggcgaaatccttatcagccgtcagcatgcttgaacggatggattgcaaattttccatgctgatatttgattccgcattagcgcttgttaataaattcgttaaatacttgctgacgatcaatttctgccggacgatcagcttcagcacttcaatcgcctcgccgtcttttacaaccgccggatgagcgagaagcggacttttcggatctctgtaaaagacatcgagataaggaaaaagcggtttttccgccattttctcaccgattaataagactctttgcttggacgtgtcaatgcgctggtcgacaagcttatccaattgaaaccgcgcttcacggatggtgtgtccggaagcgctgagcaccgtcgtaatgaatgagccgcccgtttcctgttccgcctgggaggactgaaccttccgataggtaatgccgattttatttttaccgtcatgatcaacatcaaggcttgcggtcagcacgagagaaatatctttcaacaaattttgatcccagcagccggcaagtgtcaggcttgcgcacatgagactgataagaaccgcttttttaatgcgcatggcggacaccctttttgcgtacaaggacaatcaataccataaacaacggaaacaaatacacaaacacaatatcggaaatgcggaaaaactgatccagctgctgtatcgttttatctgtgcttgtggcccaaatagacagaaggaagacgagcagggccagcggataaacaaaccggctgtgatctttttgattgaacagcttggcgatgccggtgcttgccaagtaaaacacgttggccagcgttgaaaagacggtcacgaaccaaaacgtcaaaaagagcagatccgtccgttcgataattctgaatgaaacggtttttaacaggtacagcacaggctccgggatcatttttatttcttcggggctgatggtgacaaagcaagtaagagtgatatacaggtaataaaggataatcaagccgtttgaaatcgtcagtattttgtagcgctggctgacggtgcagttgataaggggcccgatcacaagcgccgcctgaaagccggtaatgctgacaagtgtttgctgcaccccggtaagcatgtcttttgcggttccgtgaaaaatcggcataatgtatgtgatatcggcttttcccagtgtgtataaaagcggcagagagatcagcagcaaaaacggcgttaaaataaagctgaacctcgcgatcgcattcagcggggcttgggcgatatagacagaaccgaggatcagcattaagctgatcacccaattcggagtctgagggagcacccagatatccaataaccgtgtaaatacagaaagaatgagcgtgcagagaaacgcgaaatataaaatatacagcacctgcacccctttgccggcaagtgttccgaacacctcctccagcatttcatacaggttcagcttcggaaaccggtgaaataatatcatatacaggctgaaggtaagctggacgagcaatccggtaagcagaatggaaatccatccgctgcttcccgatttcatcatcagtaaatggggcagcgccaaaatgccgatgctgatctgcgtctgattaatgaaaaacacgccttgaagccggctgatttttttaggcttcatcttttctccacccccgaacatgttttatctgctttgaatcttgcggtctcaaataaaaaggccttcttttaataaaccaggccggcagccggataaatgcatcctttaagtcactgaaatgaaacggcgtcagagatgataaatacggaacgccgagggattcaagcttgcacaggttcatcagaataagtccgaagccgaatgcgatgccgataaaaccgaacgaggatgccagaaacataagcggaaatctgagcgttcgaatggacgtgctcatttcatatgaaggaagcacaaaagaagaaacggccgtaacggccacgacgataatcatcatattagaaatgagtcccgcctgaacgactgcgtcaccgatcacgagaccgccgacaatgccgatcgtctgactgatcggtttcggcagcctgataccggcttcgcggatcagctcaatcgtaatctccataatcatggcctctatcagcggagggaagggaatatcaacaatcgaatttttcatggtgataatcaaatcgttgggaatgacttcaaaatgaaacgcaatcagcgcgatataaaaagcgggcagtgtaatcgcgatcataaaggcgaaaaatctcagcactctcaaaaaactggcggaaatccacctcgtgctgtagtcatccggcgattgaaaaaaggaaaagaacgtgatcggcgcaatcaaggccgacgggctgccatccatcatgatcagcacacagccttccatcacgcatgcttttgctttatccggccgttccgtatgaacgatctgcggaaaaatggaaaacgaattatcttctatcgactcctcgataattccgggcgcaagcacgctgtctatacgcaggtatgacaggcgccgcttcacttcctccacaatctccggattggcgatattctcaacaaagataaccgcaacctttgatttggctctttccccgatatccatataatgaacggagagatggcggtcctgtatgtgaaaccgcagctgatgaatgttcgtttccaaactttccacaaacccgtcatgggcgccgcggacgatactttcagattcgggttccataatggaacgcagcggattctgcccgacggaaaacagcttcgctttccttgatgcatcgctgagaaaaacaacctggcctgccaaaatcccgtcaatgagttttctggtttcatccgtttccgcactgctgacggcattcatcgtttcctcaagcggaccgttctgcagggtgtcgcttaacagaaactcattcagcttctgttcttctatcatttgttcaatataaaagaaagcggtatgacggtcctgcagtttgatccttcgtattttaaaatcaccgcaaacacacatcagctcctgcatttcccgtacagccgattcaaaatcgccggaaatccgcttgttttgtttatccgcagacatcagaccgcctcctttcccggttatttgtagttttcagcgggtattccttttttatgcattttataaaatagaggagtttctcgacgttttaccaagaacttcacaattatggatgaatatttcttgaacgaatataaagatttattaaaattatttcaaaagagtgataaatgtcctgtaaatgctttaaaaggagataggctttccgcatataaaatgtgtatttcttgtaaacactccggacccgtctttttctgtcacgtaccagtcattccgctagttattttggaatgggactgaaagcaggatacgggggaaaaatgaatgactttaagaccttatccttaacaaaacaggcagtctgcacacagcggacatagagtcccgaaacgtatgcgcagtgcggaaaacgctgatataacaggctgtaaaagatggattatcattacatctttttcttccggaacgcgtatagtcccattggtccaaatgaatttatgtgcggaaatgtaaacgcatacatttttcttttaaaaaattgaagtaaggtttaagtcctgcctattcccaaaaaaagcaattcgataataggaagaatagcgtcactaatagagaagtttggctcagtgaaagcgggaagattatgttacataatgccgattgagaattcatagtgaagctatatactgatgaatgaatttatcaatacagaaggagatgtcaaaaatcaatgtggttactcattatagcctgtgctgccgtactaatcatcggaatcattgaaaaaaggcggcatcagaagaatatcgatgctctgccagtacgcgtcaatattaatggtatccgcggaaagtcaaccgtaacgaggctgacgaccggaatactgatggaggcgggctacaaaacagtcggaaaaacgacgggaacagatgcaaggatgatctattgggatacacctgaggagaaaccgatcaaacggaaaccgcagggcccgaatatcggcgagcaaaaagaagtaatgaaggaaaccgtagaacggggcgccaatgccattgtcagtgaatgtatggcagtaaacccggattatcagattatctttcaggaagaactccttcaagccaacatcggcgtcatcgtgaatgtgcttgaagaccatatggatgtcatggggccgacgcttgatgagattgctgaagcttttaccgcgacgataccgtataacggtcaccttgtcattacagacagtgaatacacagacttctttaaagaaaaagccgcagagcggaataccgaggtcattattgcggataactctaaaattacagatgaataccttcgaaaatttgaatatatggtctttcctgataacgcttccctggcgctcggcgttgcccaggctcttgggatagatgaagaaacggcgtttaaaggaatgctgaacgcgccgcctgatcctggcgccatgagaatcctgccgctgctcagcacgaaggagcccggtcatttcgtaaacggctttgccgcaaatgatgcatcttctactttaaatatatggaaacgtgtaaaggaaatcggctacccgacagatgaaccgatcgtcatcatgaactgccgcgccgaccgtgtggacagaacgattcagttcgcaaacgacgtgcttccgtacattaaaacgaaggaactcatactcatcggcgagacgacagaaccgatcgtcagagcttatgaagaaggcaagattcctgccgatacactgcacgatctggaatataaatcaacagacgaaatcatggacgtgctgaaaacaagaatgcaaaaccgtgtcatatatggcgtcggcaatatccacggttcagcggaaccattaattgaaaaaatccaagagtataaggtgaaacagctcgttagctaggaggaaaaggataaatgttcggatcagatttatacatttcacttattttaggcgtgttaatcagtttaattttcgcggaaaaaacaggtatcgtacctgccggtttagttgtgccgggttatttagggctcgtttttaaccagccggtctttattttactcgtactgctggtgagtcttcttacatacgtgatcgtcaaatacggtttatccagatttatgatattgtacggacgcagaaaattcgcagctatgctgataacgggaatctgcttaaaaatcgcccttgattttctttacccgatcgtaccgtttgagatatcagaattccgcggaatcggtatcatcgtaccgggtctgatcgccaataccattcagaaacagggattaacgattactttcgccagcacgctgttcttaagcggcgcaacttttgccattatgtttgcttactacttaatctaatgtaaggtgtgtcaaacgatgaaaaaacaattaagctttcaagaaaaactgctgaagctgaccaaacagcagaaaaagaagaccaatcttcacgtttttatcgcgctgccaatcgtcttttgcctgatgttcgtctgcatcctgacagggaaggcggaaacgccgagtgtgaaaagaaatgccgatgaccttgtatcagcctcatttgtcggagatattatgatgggccggaatgtcgagaaagtgacaaagcataaaggcacggagagtgtcttccgttatgcaaagccattcttcgaatcatccgactatgtgtcagggaactttgaaaacccggttacatataaaaagaactacaaagaagcagaaaaaaatatccaccttcagtcaaacaaagatgccgtaaaagtattgaaggacatgaatttcacagttctcacggcagccaacaaccatgcgatggattacggccctcaaggaatgcgggatacggttgaagagttttcaaagcaaaatcttgaacttgtcggagcaggcctcacgctgaaggaagccgagcagaacatttcttatcaagatgtaaacggaatcaaaatcgcaacactgggtttcactgatgtttccggaaaaggttttgcagctaaacgaaatgcgccgggtgtgcttccggccgatccagagctgtttattccgatgatttctaaagccaaaaagaaagccgatcttgtcattgttcaaacacactggggacaggaatacgataatgatccgaatgacagacagcgccaattggcaagagcaatgtccgatgccggagcggatattatcgtgggacaccatccgcacgtgctggaaccgatcgaaatgtaccacggcaccgttattttctacagcctgggcaacttcgtattcgaccaggggtggacaagaacgagagacacggcgcttgttcaatatcatctccagaaaaacggcacgggacgctttgaagtcacgccgatgaacattcatgaagcaacgcctgcaccggttaaaaaaggcagcatcaatcataaaacgatcgtacgtgaactgacgaaagaatcgaatttcaagtggagcgtcaaggatggaaaattaacgtttgatgtggatcacagcgatatcttaaaaaagaaagcggagtgaaaaacaaatgaaaatcattaaagcgggatggccgtttgccgcgatcattatggtatttatgtttatgtctgcgtttaaatacaatgatcagctcacagatcaggaaaaacaaaaaattgacacggaaatgcaaaaaattcagcaagaggacacagcgggcgcaaaataagcgcatgattccgcttgccggcatattgtttgttccgaatccagtaaagaatgcccatatcgggcattctttttttgtgtgctctcctaaacatttgttaaaagttaccgatgtaaaaactactaaaaatgaggagagtgaatagaaaacatgctcacaagctggaggaagtacatccttgccggccttatgatttgtcttgtggcacctgcagtaacgagaacggaaattgccgaagcggattctcaagtttctgtcctgatcgtttcagacgcgcaaaaacttgtcggaaataaatatgtttacggaggcgaagagcctgaggacggttttgacccgtccggattgatgcattatcttttcagcaggcagaacatccatctgccgagaacggtcagtgatcaatggaaagtcggagccgccgtcaaagaaaatgaccttttaccgggagatcttgtgtttttcaaaaagtcagattcaacacaaaacgcggccgtccatgacggtctgtatatcggaaacggagagatgatacacagttctccgtcagaaggcgtaaccgtcacacgctttcaaaaaagcagttattggatgaatttatatcttggcgcaaagcggatgacaaaagatccggaactggctgatgatccgatcgttcaggaggcagcccgttacctcgacattccgtatgtattcggcggaagcacgcctgaggcgggattcgactgttcggggctggtccaatatgtttttgaaaacaagcttcacatttacctgccgagatctgcggaacagcagtggctggtcggtgagaaaatcaaactgagcgacataaagcccggggacgtgatttatttcagcgatacgtataaaaaaggaatttcccatgcgggcatttatgcgggagagggaaggttcatccaagcaagccgctccgaaaaagtcaccatttcttacttggcggaagattattggaaaaaacatttcacaggggtgcgccgattcagcaatttagccatttctaaagacaatcccgttgtgtccacagcggccgatcatatcggaatttcttatctgaaaggcggcgcttcaccggaaaccggctttgatacggcgggatttgttcaatacatctatcaaaaagcgaaaggaatcagcctgccgcgttatgccgacaagcagatgcaggcgggcgttccggtcgataaacaagatctgaagcccggcgatctggtcttctttaaagcggaaagcctgaatccggccatttatatcgggaacggacaagtgattcatgtcaccgtgtccgcaggtgttaccataacaaatatgaacacaagcgcttattggaaggacaaatatgcgggcggcatccggcttccgtaaaaaaagacgtcagagagtgtctctgacgtctttttcttttaccgtttcggcgctctgtatccggccgctatcgcatcctctacagaacagaacatttccgcgggatctgtcgtccggtcgtagtacgtacttcccggcgtgtgataaatgccgtaccggctgcctttaatgtcgcatccctgtgaggtgccggctgctttcgtttcggcatgtcctccggaggaaggggcgttgttttgcgccgtttccgcgttttcggatgtttttgtttctgctttctgccgctttaaagttttattttctgactgaagcgtttcagcggtcttttcgagcttcttttgtgaattttttaatttctcattgtcttgtttgagtgatttgtttgtttttttcagctcgcttatctcttggctgagtttgctgagtttttcttcattgccggcttcagcttcggatttctccttttcggctgcggcactgatgctttcatattttttctcaagcgcctggtgttccttcgtcaatttttgataagccgtatcaagggtgctgtatttctcctctgccttcacggccgaggcgtccggctctgcgagggatgcaccggtcagaagcaggataaatccgccgatgagaagaggccaaaacagcttttttgaaaaatgtttttctttttttgccgctttgcatatgagatgaaaaattccgtatccgactgcgcagagaaaagctaaaaatcctataatagcgattgcattcgacatcatgaaactccttttttagaaaacatgaaaaagccaggccgtgaaagacctgacttttaccttttattgcccattgtcgagaagccggttgatgaaatatgcgacgccgttttcatcgttgctttttgtaatataggtgcttttttctttcagttcatcaatcgcattgcccatagcgatgcggtttcccgccgcttcaaacatggagaaatcattcgggctgtcgccgatggcgtaaatatcctgtttttcaattccgtacagtgaggcaagctccgtcagagcacgtccctttccggaaccggcagggaggatttcgataatgtgttttccggaagatgtctgggataatttccgatgatgtgtaatttcttctttggcgtttctcagtttttccatatcaaaagagaaacaaagaagcttgtaaacatgttcgtctccgttaaaaatcgcctgtatatcctgtacgggtttaatgccgaattgtttgaactgcgtctttgcgccctcccataatgtctgaatatcttccttaggattggcgcttttcagaatgtccagttctgcctgcagtttggactcgccgtcaaacggggacagcagatgatcatctgtatagacctcaaagtaaatgtctttgtccgttaaataagcggcgatatccttcccggcctgctgatccattaagagccggctgacgaggcggtatcctttgtcatggactgtcccgccgtttgccgcaatgatcggaatatccaaatccttcaagagcgcttttacatcaaacgtggctctgcccgtgcagatggccacgagaatgcccgcttcatccgctctttgtaaagccgctctgttttccggagaaatcacactgtccgaattcagtaatgtgccgtctaagtcaatggctatcaatttcatatgtatggatgccctccttaaaaataaagctgcttcatgtagtatgttcagctttgtgcgaaatcagcagaaagccgtcagttaaaaggctataccttcatgtcctttttttcaacagaaaaacggcgggatttgctaatcccgccgtgacatcttacgcgtctaaatcattttttaatttcgtttttacttcttgaaggttttcctcattcagcttgaagtaataaatatttttgccgtactgaggagtgtaaatgtagctgtctgaacctgtcagctgcaaagaattcaccgatttcagcgatgtgataaacgggaacagaccgatggcgtcattaagagataagttcatttttaagtttttccctaagctgtcgacgatatcgtcataagatgggatcgagcttaacgatttagattttttaataatggcgctcagcacttccatctgtctttgtccgcgcatcagatcggtgtccgctttgcgtgttcttacataagccagtgcctgctcaccgtcaagcgtctggacgcccggcttcagcacgacttttccttttgtatcgactttaatacgatcggcaattttctggcttttcacatttaccgtaacgccgttcaactcattgacgacatcgcggaacgcgtcgaagttgctttcaaccacataatctaccggaatatcaaacatgttttctactgttttataagttaaattataaccgccgtaagcatgtgcgtgcgcgaatttgtcatagccgtgtcccgggatgttgacataggaatcccgcggaatgctgagcatcgtcgctgttttctttttccggttgaaggtgacgagcacgttggcgtcacttcttgcgtcatctactgattcacccttattgtcacgggcgtctattcctaaaagcaatacggtgaaagaatccttcttcgggtcaaattctttgatccgttttacggactggtcgccgcggtcaaggctgacgtgcgcttctttggtcgcattattcaatttcacaaatgcgtaggtgccgacggaaccggcgatcaccaataagaaagcggcgaataccagtacaaatttcacccattttctgaggcgtcttttcttttttctgcgttgagatcgttcttccatatcattacctctcgtttctattctttgtgaagcgtaccataattgttgactcggagcaactctgcaaatgagaaaattctaaatctttctctctatttcgacaacatctactgttatttttgcatcaggttcacattatattggacggcaggaagcgggaaatgtttcgtcgctttgtgaaaaataatcagtaaaataatggatattaacggtgcggaaggtttgaaacgatcggaaacaggcaaaagaagcagtagaacaattccgcgcggatacagcgttggatgaagggagtctatataacatgaaaagcatacactcgaataaatggctctattttttcggcgctctcgggggcgcgttatacggatatgataccggagtcatttccggagctattttatttatgaaaaaagaactgggactgaacgcctttacagaaggcctcgtcgtcagttcgttattggcgggggcgattctcggatcgggattcgccggcaaactgaccgaccggttcggcaggcggaaggccatcatgggagcggcgctgctgttttgtataggcggattaggagtcgcttttgccccgaatacagaggtgatggttcttttccggattattctcggactggctgtcggaacatcgacaacgatcgtcccgctctatttatcggagctggctccgaagcataaacggggggcgctttcttcgctgaatcagctgatgattacggtcggaatcctcgtttcttatatcgtgaactatatatttgccgatgcaggcgcttggcgctggatgcttggacttgcggttgtgccgtcagtcattctgctgatcggaatcttatttatgccggaaagcccgcgctggctgtttacgatcggcaaagaagagaaagcaagagaaatcctttcatcattgcggggaacgaagaatattgatgatgagattgatcagatgaaagaagcggaaaaggaaaacgaaggcggcttgaaagaattgtttgagccgtgggtgagacccgcgctgattgccggcctcggacttgcctttttgcagcaattcatcgggacaaatacaattatttattacgcaccgaaaacatttaccagtgtcgggttcggcaattccgcgtctatattgggaacggtcggaatcggcgccgtcaatgtcatcatgacgcttgcggctattaaagtcattgataagatcggccggaagccgctgctgctggccggaaatgcgggaatggtcatcagtctgctcgtattggccgcggtcaatcttttctttgaacattcagcagccgcatcatggacaacggtgatttgtttaggcctgtttatcattgtgtttgcggtcagctgggggcctgccgtgtgggtcatgcttcctgaattattcccgctgcatgtccggggtatcgggacgggtgtctccactttgatgctgcatgccggaacattgattgtctcattaacctatccgatgctaatggaagcagtcggcatcagctatttatttctcatttatgccgctatcggaataatggcattcctgttcgtccggtttaaagtgaccgagacgaaggggaaaagccttgaagaaattgagcaggatctgaaaagccgtaacggaggctcgggatcagaatcaaatcggcggacagttcatccgtaatattcagttttaggggggcggttattcaccggcccctcaaaacggatgcgtgcgggcgcccgcacggtcacataaatgacggggatatgtcatacgttgtataaagtcacgataaaggcggggatgccggtgaaaacgagtattattatccttacatataatgaacttgagctgacgaaaaaatgtctggccagcattgaacgatacaccgacaaagataagattgaactgattatagttgacaacggttcctcagacggaacgagagaatacatatcaaatctgcctgacgtcaaagtcatccttaatgaaaaaaacctcgggttcgccaaggggtgcaaccagggaatcgaagcggcagggggagaaaatctgctgtttctgaacaacgatacgatggtcacgaaaaattggctcacctccatgctgagggtgctgtatcaatctgaaaaaaccggtatggtcgggcccgtcagcaactatgtcagcggcgcgcaaatgatccatgacgcgtatcaatcgcttgatgagctggagtcattcgcggaggcgtattgtgcacgggaaaagcatcaaacaaagcgggtgctgcgccttgtcggcttctgtcttctggtgaaaaaaagcgtcattgaagacatcggcccgtttgatgagcaattcggatacggttcttttgaagatgatgacctatgtctgcgcgccctgcaaaaaggatacagcctgcacatcgctctcgatgcctttgtgcatcaccacgggcatgcgacgtttacggctaatcaggatatcaatatcaatcagttatattcggagaaccgccagcgttttacggaaaaatggggcactgattttacgtactttactcatccgagaccggaaattgcggagctcgttccccgggaggcgaaacggatacttgatgtcggctgcggtgcgggagctacggggctggaacttcaaaacagacagccttgcgaactgtacggaatagaactgcacccgctggcggcgcaagcggcaaaaggacattatgaagcggtgctgcaggaagatgtcgaaaaagtgaagctgccttatccggaaggcttttttgattgcatcattttcgcggacatccttgagcacttaaaagacccgtggcgcgtcattgaaacgtactcatcctatttgtcgcctgccggatcaatcgtttgcagcattccgaatatttcccacgccgaagcgctgttcccgcttctgctcggggactggacatacagagacgccgggattctcgaccgcacccacttgcggttttttacgccgcagacggtgcgcacgctctttccggaagagacatttgacgtgaaaaagcagtcctatacgtatgttcacgtggatgagcgggtgcagctgtttttacaggaaatcacacgaatggcgcaatcgatgcaatttccggtgacacagctgcccgaacaaagccggatttatcagattctccttcgtgtcgaaaaaacacgctgaaggctaccgccccatcgttccgaagttggtaatctgaatggaaacatcatagtcaaaggccgcttcggagaaggtttcatcccagtgatgcttcactttcttccaatagtcgggatattgaatgcggactctgtcagaaaagaagacagggtccgtttcatattgattctgcagcttatcgatgacttctttcatatcgcttttcagttttttttcgaaaaccttttccagcccgtttaaatagtgctgatcgaatgaatcttctccggcatattgatcctctgacaaaagtccttttgttttcaccgctacgtgaaacgacagcttcccgtttttcagcagggggtgatggaggatgttgattttttgatctcgaaggtaattgggtgccctcctttatccaaagcgggcagcacgccgccctgtatcgtccccgtcagccaattcaggctttgtacttcgtatgatgacagaaagcctgccaatctgttttgttttccgtttttgataatggccgctccgtcatacaccgtttttcctttttgattgctgacggcctgaatgagaaaactgagtttattatggcagtaaatcgaagctctcccgattcggagcggttttaaaatcttcccgttgtagccgccgttgttcgtaaggtcgatcagcttttccgcgggcatgggctgctgctgattcggcgtcggctctgtcagaatatcggccgctttgcctcttgccgcgaagagatagctgctccgccttaattcatcatcacggataaaatggttcatcatctgcagtatattttggtcggccagcaatttgtcgctgaatatcagcacttttaaatgatcgctgtaaacgggcggatcttttaaagcgacttcactgacggcttcaagaatggtatcccccgcgacgtcacattgacaaacacgggccggccggaagcctggctgttttcactttggggcagcaggttttgataggttaatttatatcggcggtcactcgtctcgtctatcgccagcccccgggcgaaagatagcttttcgacttccttcgcatcccagcaccctgaaagcgtcatcagtatgaaaagcgccgccgcccattttacgaaatgtgtcatgacgtctgtttcctcccggctatttttttcatccagctgacaaaccagatgagaaaaggaatcataatgacggcaaaaaacgcatatccgagaatattcgcgaatgcaaacacactgttgatatcatcagggtacattgaaaggccgaatgtcactgccaataagccccccagcagccaggcattgtttttatttttcagtctgaaaatggtgtttaacccgagatgcgctcctttaaaagaaccgagcatacaggtgaactgctggcatgtccacgtaattaaaagaaagatatcaaacctttcgatgaaaataccgcggatttccaaggcgtgaatcagggaaatggtcggatatgtcaccgttttggcttcagcgatcgacatacagccgattacgacaagcagcgtaaagctgtaaaataagcctgcgcatgcgatgccgaagacggcagcctttttcgcctgcttcggatttttcataaacggcaccagataaagaatcacctcaagtcctgaaaaatacagaagggtacgcggaaacagctcaaaaaagcttttgtagcctccttccatgaccgggcggatgaaatccagtttaaacagtctcaggctgaatatgagcagcgtaatcagaatgacgatcgcaatcggaaagagataagcatagagttttgaaatgggatacaccccgccggtcacatggtagatgccgaccgccagaaagatgaatatgacgacacccatcggcgtatttttcagtaaaaagtaattgatgacctcaccgagaaaacgggcttgaaaacagacggtgacgacaaaataacagctgatgaataaattaagaagagaaccgatggcgcgtcccataatgctttgattcagctcataaatggtttccccgctgtttttctgcaaaaatggcataaagagcaggacgatgccgataaacacgagactctgcacaagaataatgatccatccgctcggactgtccgctgctgcggcggagcgcggcagtgttaacacgcccgctccgatcattgttccgcttaccatgagaagtgtctgcataaacgacagcttgtcttccggttttttcatggtgatcacctttgcttgattttatctttcgtctcttttctggtcggccgttttttcaaaagaggcgtcggcagtctgacgatcgtatcttttaagtcctgtcccggctgcgccatgatcggaataagatagtcctggccgaagcttttcaggcgcatcagatggccgacgacaagcagataacacatgatcagtccgtataaacctaatatcgccgacaaaatcatcgaaaaaatacggatgagtctcagcggaaaattgaacgcataggagggcgccgtaaaagaagccaatgccgtaacggatacgataatgaccatcatcgcgctgacgatgttcgcctgaacggcggcctgcccgatcaccacgcccccgatcaggccgatcgtctgtccgatcggcttcggcagcctgagtccggcttctctgatcatctcaatcgtaaaaatcataataaacgcttcaacaaaagggggaaacggaacattcaatctgcttccggcaatcgtcaccgccattctcgtcggcaaaagccccgtgtgaaacgtaacgagcgatatgtaaaggccgggtaaataaatcgtgattaaaatgcatgtataccgaagcagcctgagaaagttaaccggaacccaccgctgattataatcgtcaggtgagtggataaattcatcaatggtagccggcaccaaaagggtaaaaggcgttccgtctacaagaatggagacccttccttccaaaagagcgcccataacccggtcgggccgttcggtcgtcaagacggtcgggaaaatggaatacgtgttatcttcaataagctgctcgatcgttcctgattccggaatgtcatcaatggtgatcgaatccagtcttttcatcacttcttttacaacatcatcaggcgcaatatcccgaatgtaggcaacggcgatccgcttttttgtccgttcgccgagtgtgatctctttgatctggaggttgggatcaccggactgctcgcgcaaaagcgccgtattcgttcggagcttttcgacaaaacctatcctaggtccccgttcaagcacttctgaagccggttcttcaatatcacgcattttaaatgtttccgtttcaaacgaaagggcttcctcccatccctccgccagcaaaaccgatttgccggaaaaaatgtctgcctccgcgtccttaagtgaagaaagccgggtgtgacgatagccgaaagagatggatgacggcggtatttcagccggttcctcttgatgcagggcggccgcctgcacgggcgaaataatatattccgcaagcaattgattgtcggtcagtccgtctatatatataaggcaggcgtcacatttgccgtttccgtacgtaaacgaataaaacatcatgtcatcgctttggccgatccgttttttcagcgcttcaaggtttttgccgagctccgcatgtatcgtcataatgttcccccctttccatcagttattttaatttgcgacaaacaaggcattttattctggaataggaaatgactgagcattccgccccatccgaatggtataatgagcaggtcagccattttatacatattgtttttaaccgcggctccctccgtgttttaaaaaagacacagggggaatgggatatgagccgctttttaaggggaggggaacgaacatgacgcaagagccgatttttctacagcctgtatgtaaagaaaaaatatggggcggcacgttattacgcgaacgattcggatatgacataccttcagaaacaaccggcgaatgctgggcgatatcagcccatccgcacggaatgagcacggtcaaaagcggtccgtatcaagggaaaaccttgatggacctgtgggatcagcatagagagttattcggcggaacggaaggggaccggtttccgctgctgactaaaatactggacgccaaacatcatctgtccgttaaagtccatcctgacgattatgacgccgaggagcatggacagggcgaaacggggaaatctgagtgctggtacattattgactgtaaagaaaatgcggaaatcatatatggtcatacggcccgttcgaaagcggaacttgtcaccatgattaacagcggtgactgggaaggcctgctgcgccgcgtgaagatcaaacccggcgatttttattatgtgccgagcggaaccatccatgccatttgcgccggagcgctcgtgctggaaatacagcagaattcagacgccgcctaccggatatatgattacgggcgtacagatcaaaacggcggtgcgcgtgagctgcatatccgcgatgccgtcaacgccgccaccgttcctcatgtggacggatttttggatgaatcaactgaaacgagaaaaggcatcaccattaaaacctttgtgcagggagaatatttttctgtatacaaatgggatatcagcgggacggcggaaatgacccaggacgctccgtttatgttatgcagcgtcacagaaggaagcggctccatcatctttgaaggcaagtccgccaagcttgaaaaaggcgcgcatttcatactgccggatcagatgcctgactttacgataaacggagattgcacgatcatcgtttctcatatataaaaccaaacttaatcccagctctgggattaagttttttttatttggataattggatgatttctctctgtaaaaatgaagaaagcgggccgataaataaactagtttgatagaaaccaattgaatcagaaagaggagaaggaatgaaaaagagattcgttgcacctatgttattgtccgccgttttccttgtctttagcaccgttacacagcacgccgaggccgcatacagcgactactccgtttacgagctggaaacgaagcagcaatttgcttctgagaacgaggcgcttcaagcggcagcgaaattgaaaaaggatacggggtggcaggctgacgcaaagaaagccggaaatgcgccgctcacttatcaaatctcagcttcaggcttacacgatgaaacggatgcgaaaaccgtgctgaaagattttacgaagcagacgggcgtggccggcacttacagcgcaagcggaagcaaacagccgtacgtgaccgtcacatcaggcgttctatcagacgagcggcagacgaaaaatcttcttgccgaactgacgaaaaaaacgggcgtgaccggcgccgtcaagccggcggggacaaaacagccgtataagcaggtcgtgacttctgagatggcggccgatgcggatgcaaaagcgctctcgcaagcgttgacgaagcagacgggcgtgaaagcgtcataccgtcagatcaaacgggaaacagcccggtttcagatccaatcgggaacaatctccggcgatcaaaaagccgctcaaattcaaactgattttcaaaaggaaacaggattgcagtcgtcgctgaaagtcacggcaaaggccagtccgaatatcaccgtgacagcctctgacattttaaatgcaaataatgcggcaggtttagcgaaacagctgcagcagaaaacaggcgtcaaagggaacgttcaaaagtatgcccaaagcaaaacagcaaccgtgtataacgtgcagtcaggatattttaacggagtaagcgccgtacaaaatgctatcacccaaatcaagaagaatacgggtgtcagcggaagctatcaaaaagccggcaagaagaataattacacggtcgcgatgagcggactgacggctaaacagctgcaaagcgtgcaagctttctttaaaaagaaaaaatggcattgcgacgcatcgcctgtcaaaaagacagcatcagtgtccgtttaccggatcacggcagggcagcttaccgctgcaaaggcggatcaaacggaggcgtttttccgccagcagcatgtaaagacggcaagaacagcggcgggaaaaacagcagaaaacgaatatcagctgctttctcagcagacggcagaccagtcgaagataaaaaaaggattgaatctgctggcgggatataaactgactgccatttcaaaaacgatatccaagcagacggacacaacgtaccaagtcacaaccgaatcactgcttgatacggcaaagatcaatcaatcgctggattttttcaaagggaaaaaagtatccgcctccgcacagaaaacaggtgaagcggcgtatacacaattcagaattgaaacggcaccgctgcttaagaaggaagacattgaccgcgtgactgcttttttcaagcaaaacaaagcggccggcactgtgaaggagacggggaaaaccggctctgcacaatacgtcatcaaaaccgaaaaattcagcagtaaaaccgttttaaataaaagcatgagctttttcagcgccaaacaattacaggccggctatacgagtgaaagccatccggtttatgaactccgcattcgcaatcaattcacgggagcgcagtcagcggacgccgcctcccaaaagctgaaaaagctgtacggatggacgatggctattctgaaaataaaaaacggaccgcaaatcatgaacaccaattacaacatctcgctggcagatatggtcaaaaaacaaatgacagtcagcccgcagactgatgccgcggcttatgcatcgcttacgtacatcaatacggcctccggaacggtcacagccgacgtcctgaacgtccggtcaaccccggaagtcagctcaggcaatattatcgggcagttgaaaaaaggcgataaagtcagcatcacaggccagacaaacggctgggccaaactcagcatgggctggagaaacgccagcagtgacgaagtcgggcagtacgtcaatccggctcacttcgcacaagacagcaagtattactttcaatttctgaagctctctcagacagccggactgaacgcatcggaactgaatcaaaaagtgctggtcaataaaggaatactgacagggaaaggccaggcctttattacagccgccggcaaatacagcattaatgaagtgtatttgatttcgcatgctttgcttgaaacgggcaatggcacgtcagagcttgcgaacggcattatgtataatggtaaaaaggtttacaacatgtacggcatcggggcttatgacagcaacccgaattactacggcgcacaatacgcgtataagcaaggctggtttactccggaagccgcgattatcggcggagcccaatttatcggtgcgtcttatattcacaatccttcatacgagcaggatacgctgtataaaatgagatggtctccagccgcggctcatcagtatgcgacagacatcggctgggcgtataagcaggtaaaccgcatgtacagcttatactcactgctggatgactatacgctttactatgatgttcccgtgtatatgaaagtataaaaaaagggctgaagtgtatgcttcagccctttcttcatgcaaaaaacacccgcctcagattcaggcaggtgcttcagcacaatttttcatttttgtttccgcaaatttcaataacgcttcactcgaattcccatctgaatacatattccatttgtccgagaaccgcttcatttcttctgcatcaaatggctttttcgtcatttcctccaaaagagcttcactgtcatgacaagcctttccgggaatgacggaagtataattgtcgattaaaccgcgttttcgatcatattcctccagatcatacgtgaaaaagaaaatcggtttatttaagagcgcgaattcaaaaggcacggaagagtaatccgtaattaaaatatcagccgctttcaagagatcatgaagacgcatgtcagacacgttcttgatcaattcgctttcaaacgaagccgaaatatgatgcaaaacggcaggatgaagctttacaagcagcatatactctccgtttaacgcgtttgtgagctgttcttcggtgaatggcagccgaaaggactgcatatcataatccctgaatgtcggtgcgtacaggatgatttttttcggccatttgtgcttcggttcgggcttgtgttcttcataatagacgtcagtcagggggacacccgtttttaacagctggccgtcccgtatgccgaacgactttttaaaaacgtcagccatcgcgtctgaaccgacggtgacaaagtcaaacgagcggtacacttttttaaaacggctgatgtctgatgccggacggttttgattcgtcacatcctcaaggccgaactttttcaaagagccgttcgcatgccacacttgaatacatgtcgtttgcggccggcggtttaagacgcttgtcatgaggaaatagttatccgttatcaccgctttgctcttaaaaaggatcaaaaccgccttcaaaagatgcagcggatgtttttcgttcagataaaaagagccgagtccttccagctcttttttcagactgacggcgtgtctcgtatacaaaaccgtcacttcataagaaagcgattcagcgtgcgctttgtaagaacggatgagagcctgtgcattctcttcaaaagataccagcagggtcagatggttcttgggctttacaggcttgaacaaaacgcccagaacagacagatatatagaataaaaagcggcgaataaagatcgcaagttcatagattaccaatctcttttgctgttttatttgtttaaagctgtttcgtttgatcttctgcctgctcggaatacaggcttttatttgatttattatttctcaaaacggtaaaagcatacttcggaatgttcagcatccttttccatctccacggattcgtcaccagtctgtacagccattccagattcgttttgatcatccattcaggggcgcgtttcaccgttccgctgaacacatcaaagcttccgcccaaaccgatcgatacagcctgagggaaaagatgtttgtattcataaataaattgttcctgatggggatatcctaaggcgacaaacacgagatcgggtttcgcccgggaaatctgtttggcgacgaagcgtttatccgcttcataaccgttgctggctccgacaacctcaatattcggatactctttgccgatccggttcaaaacggcgtcaagcacgtcttgcttagctccgtataaaaatatttttttagactgccggtttgcgagaccgagcagcgacagaaatacatcgaatcccgcaattcttgatttcagcgggtgctgcgtcaaacgtgacattaacacgacgccgataccatccggcaggacgaaatccgcggaagaaatgacttgatgataacctttgtctttcgccgcagcgtatccgatctcagggttgaccgtcgcaatgacggctccttgcttttgtgcgatataataagtgtctaaatatgaaataaactcctgtaaatttccattaacataagaaaggttgtgcaccatttcagtctgcatctgccgtcctcctttttgtacgggattttctttcattttttcgtgacttaagctaagctttattttaacataataccttcagataaacttaacaatagttttacaaaaatataaataagataacaatttctttaatcaaccgcgcaaaaaccctgctaaactcctattgcaataacatttgttaataagtggaatttaacttcgttttacattagcttaaccttttcagggctatgtgatataatgaggttccatgagtacgaaattggcactttagtgattaaggatacagctgcgcagcatttcagggcagttgcttgttatacgtatgatgatagaaaggagcttttgtttcatgaagaaggtcattacttacggaacgtttgatttactgcattggggtcatattaaactgcttgagcgcgcaaagcagcttggagattacctagttgttgccatctcaacagacgagttcaacctgcaaaaacaaaaaaaggcctaccacagctatgaacacagaaagctgattctggaaacgatccgttatgtcgacgaagtcattccggaaaacagctgggatcaaaaagtacgtgacgtagcggatcacaacatcgacgtgttcgtaatgggagacgattgggaaggcaaattcgatttccttaaagatcaatgcgaagtcatctatctccctagaaccgaaggcatttccaccacacagattaaaaaagaaattgccggggtgtaattgaaacattcggatatacagatgataaagaagtactccctccggatagggagtacttcttgtaatataaggttattttcgctatatttgttatgcgcttttgaaaaaaagctagacaataagaggagaatttaaagatgaatcttagtaacttttttaagttgaataaaaaagagtccaagccgtccatagaagaacgcgaatataccattttaaacaaagaagcattggcggaagagaagaaggtagcggtagtcgttcctgtttataatgcagaagaatatgtaaggaaaacagttgattctgtgatccttcaaaacatcggctttcagcatatttctttaattctggtagatgattgctctaccgatgattccagaaacatcctgactgagtacgccgaattgtatgaaaatattacagttgtctttttgaaagacaacacgggaactccggcttatccgagaaacttgggaattgagctggcaaatgcgaagtacattacatttttggatgcggatgattggtttgcgccgaacggggttaaaatcttattcgacatgcttgaaagagatcatgtaaattatgcggtcggaaaaacgatcgaaatgcaggtgaacggtcaaaaaacgatcgggaaacatgagtcttcgctgaacagagcgaaggtatcgcctttttcaatccggcatattttctatcatctgggcccgcgggcaagaatgatgaacttacaatttctaaaagataacgatatcagatatccggaaatgaaatttgctgaagataagcaattttttatggatgttcttttggcgtgcggagatatttcaacgtcaaccgaaccggtctattatctgaacagaatggacaataatgagtcgctgacaaagcagaccaatataatggaaaaaaccgacacgaacatagccgtaatgaagtatattctgaacaaaaaattagatactgaaaaagagaagatggcgatgaaccgcctgattgaattcgattccattacgcggcttttcgatcggatgcacttcctgaaaagcgaaaacaaagaagcctactacaataaattcaatgaaattctgaatgtgttaaagaagacgaaatacgatatttccgagacattttttcatccgattcataaaacagcctaccgtctgctgactcaaaaacggtatgatgaggtcgaaaagctgttccgctggtccaaaaaagagcccgataaaaacatcgtgacgaaagacggactggcttatttagaaagcccgctgacggatgaagaaaataaactggtcgaacttcgcatgcacggagaaacggaaagcgcggtgttcgccgatcataaattcaccgttacgttccgcttgttcggacaggacagaaataatgcccaatatattcagtttcagcacagagataacatgaaagtacaccaccagtttccggttcagtcactgggagacgggcggtacgtccttgaaatcccgttaagtgacattgaaaaagtcggacttggcggttatattatgtatgtcatttataacgattatgaacgtgtcatgttaaacagagaagacggtgaaaaggtgacggcagaagcgaacggactgcaatatcaattctaccggacggtgaaggagaacctttcactgaaagtaacaaaatgatgattgtgattggatatgtttaattgaaacagaggagtagacttattttatgggtatagaaaatcctgtcagatacaagttaaaacatcttaacataaaggaagagacattcagcattacgatatcctgtgaaaatgtcactgcaggggaagagccttctcttcagattataaatcgtaaaacaaaagcggaactttccgtccctctgaaacggttggccggagagggcggagagtaccatgctgtcatgagcacggatctgctttctgaccatacggacggcaaaggatgtctggatttctatgtctcctttatcaatgatgacagtgatatcagtaaaaaacggttaaaatccagccttgaacctattgaactgtcttcttataaagatgaggctcatcatatgtactttttcccttacacgacgaagaaagggaatttctccttaaagctgctgcagaaaaagttcgtcacgcggattgatgaaatggagctcgaatctgacggcagcttacatctgaaaggttttgcattccggctgaatgcggcagaaaccttaaagataaaagaaaaaaacctgattctgaaaatgaaaaaaggaaaagaagaggagcctctcattctgaagtatccgcttcacgacgtgccgagacacgaccttgatgaatatgttcaggacacaacgatgcttgacacgataggctttgatacaaaaattgatttgaatgctgtttataaagaattgaatcagcagctcatctttcaattccatattcaattcatttttgaagatgccgggacaggtgaagaggttatcaccaacagcaaaccgttaaaggttctgaaatctgaacatgtaaaccctaaccaattcacggttctgaaaacggaaaaagggcctgccagatttcacgttttcacgaaaaagaaaacgaaaaatctccacctgagaatgaacgattacagcttcagcacccgcgtggagtattttgtgaaaggtaagctgaaacggggcgcttcctttgtacgcaagagaaagaataagctgaaaaagttcattgagaaaagaatacagaacacttacaaagcaggattcagatttgcaggaaaactgcctgtcaaacagaaacttgtcatgtttgaaagctttgccggaaaacagtacagctgcaacccgcgggcgatttatgaatacatgagcaaagagatgccggaataccgtctctgctggagtgtaaaccccgcttactcacagacatttaaagataaagggattccttatatcgaacgcttcacgttcaaatggctgtttgccatggcaagagccgagtactgggttgtcaacagccgtatgccgctgtggattccgaaacctgagcatacgacatatgtccagacatggcacggcacgcctttaaagcgccttgccgtagatatggatgaagtgcatatgcccggaacaaacactgaaaaatacaagcgcaactttacgacagaggcttcaaagtgggattacctgatttcaccgaacgcatattcaaccgaaatattcgcccgggcgtttcagtttaataaaaccatgattgaatcgggatatccgcggaatgacttccttcagacggataacagcccttctgtcattaaagcgctgaaagaaaaaatgaatcttccgcaagataaaaaagtgattatctacgcaccgacatggcgggatgaccaattttataagaagggaaaatacaagtttgaccttgatttagaccttcaccaattgagagaagcgatcggcgaccgttatgtcattattttacggatgcattatctcgtggcggaaaactttgatctcggaccgtatgaaggatttgcgtatgatttctccagctacgaagatatccgtgagctgtatatggtctctgatttactcataacggactattcctctgtcttttttgactatgcgaatctgaaaagaccgatgctgttttatgtgcctgatatcgaaacgtaccgggataaactcagagggttttactttgactttgaaaaagaagcgcccggcccgcttgtcaaagaaacaggtgacgttatcaaatgggtcaatgaaacggaatcagatgattataagcttccggattcgttcgggcctttttacgagaagttctgttatttagaaaccggagaatcgtctgaaaaagccgtaaaagtgattttcggggacaagtaaataagtgcaaaaaagcataatttaaccatgttaattatgcttttttgcttaagtgacggcatgttgcgctcatgggactcaggcttgttatgaagtgaaaaatacatcgtaatctgttacaattatgagcggtgcttttgtaagtcaaagctattacctaaaacttacgactaaggaagattagaatgaatgcattggtaaaaattctgaaagagcaattcaactcatttccgctgattatgcggcttgcagtgtacgaaacgaaatcaaagtatcaagtgaactatttgggtatattgtggcagtttctcaaccctatgattcaaatgctggcttactggttcgtatttggcctcgggattcgcggcggacatgatatggtgcttggaaatggagacagcgtaccgttcatcgtctggatgctggccggcttaattccttggttctttatcagtccgacgatactggatgcatctaacagcgtttttaaacggataaatttagtgtcgaaaatgaactttccgatcagttcactgccttctgtagtgatagcatcgaatttattcagttactttgtgatgatggcgatttatattattgtgctgctgagcaacggactgtttccgacgcttcactggctgcaatatatttattacttgttttgcatgatcagttttatgtttgctttcggcctgtttaattcaaccatcagcgtattaatcagggactatcagtttttgcttcaagccgtcacaaggcttctcttttttcttctgccgattttctgggacattgcggagaaatttggaaacagacctgaagttttgaccatcttgaagttaaaccctcttttctatattatcgagggcttcagagacagctttatggaagggcagtggtttttccacgatgtgaaatacacgctgtatttctggttcgtcacactgctgctgttaacagtcggttcacttcttcatatgaaattcagagataagtttgttgactttctttaatatagtaaggagattatacgatgaaactaaaagtttcgttcagaaatgtttcaaaacagtattttctatataaaaaacagtctgacaaaattaaaggattgtttttcccaaacagaaatcaaaaaggttttttcgctgtccgaaatgtttcttttgacgtctatgaaggggaaacgatcggattcgtaggtatcaacggctcgggaaaatcaacgatgtccaatctgcttgcaaagatcattccgccgacaagcggtgagattgatatgaacgggcagccgtctttaatcgcgatttctgccggattaaacaatcaattaagcggcaaggacaacatccgtttaaagtgcttgatgatgggtctcaacaatcggcagatagacgagctttatgaaaaaatcgttgaattcgcggatatcggcgactttatagatcagcctgttaaaagctattcaagcggtatgaaatcccgtctcggttttgccatatcggcgcatatggaccctgacatccttattattgatgaggcgctctcagtaggggaccagactttctatcagaaatgtgtggaccgcattacggaatttaaagaacgcggcaaaacgatctttttcgtcagtcattccatcggacagattgagaaaatgtgtgaccgggtggcttggatgcattacggcgaaatgcgtatgttcgacgaaacgaaagccgttgtaaaagaatataaagcttttgtggattggttcaacaagctttcaaagaaagaaaaaaagaaatatcaaaacgagcagattgaaggcagaacgcgggcagccgaggaacagaaaatcactcaggcccagcaaaagaaagcgaagcctaaattcattgccaatacgatacagattacgctgcttgcattgctggctgtcggcgcaggcgcttcgatgttttcagacaagcctctgcgtgcgatcacatctttcggtgacgtcaaacagagcgatgccggcctttatgagtctgtgaataaacctgctttggtaaaagctgaaaaggcggacctttacactgaaaaagatataaaaggaaaagcctccgcaagtgtaagtttcggtacgaaggtgcagatagaagccgagaataaccaggcggctaaagtgaaattaaacgataaagagtactttatgaaaaagactgatctatataaagtgaacgctttaaaaaagacggatgttcagctgaatgatttcagcggcagtttatcaagccaaacagcagaagagtttctctcatatctcaataaaagccgggacgatgtgcagcgtaaattgaaaaatccagctgcgggacaaacggctgacggacggaacgtattaaaagcatccgatgcaaaaacggatgtagtgattgacaatgatacagtctccgaagtggtttttcatttatcgcgtcctgcagacatctcagctttaagtgaaaaaggcggcagcaaaatcaatcagaatttgctcatgcttaaaaaccaggaatatactttttctgtgaacaatgctgataagacactgacggtaacgtctaaaaagtaaagatcacataaaaaaagctgccggattcggcagctttttctattcgtcagcttcttctttttcaagaagatccttcatgaacggaattaatttatggcggatatcctgatcctgtaaggcaaattcaagcgtcgtctcgataaatcctagtttttcaccgacatcgtaacgttttccttcgaaatcataagcgaagacacgctgaatgtcattgagcttttggatggcgtccgttaattgaatttctccccctgcaccgacttcctgctgttcaaggtacatgaaaatttcaggagtgaaaacgtatcttcctaaaatagccaagttggaaggagctgtgcccggttcaggcttctctacaaaatttttgacctggtaacggcggccttcatttgttaacggatcgataattccgtagcggtgtgtgtcgctttcaggaacttgctgaacaccgatgatggaagacaatgttttttcgtattcatccatcagctgacgaagtcccggtttttcagcctggacaatatcatcgccgagaagaacggcgaaaggttcatcgccgatgaagttgcgtgcgcaccaaacggcatgaccgagtccttttggctctttttggcgaatatagtggatatccgcaatatttgacgattttttcactttttgaagcagttcgattttccctttttcttctaaattgcgttccagttcaggggcattgtcgaaatggtcttctattgctctttttccttttccggttacgataataatatcttcgatgccggattcgacagcttcttcgataatatactgaattgtcggcttatcaacgattggaagcatttctttaggcattgcttttgtggccggcaaaaaacgagtgcctaaacctgctgccggaataatggctttgcgtactttcttcactgaataacaccatccttgtttctgcaaaatctttttttcagaactataacctagtctttttccactttaccacaattgattaaaattcacaccttttaatccgctttcaaagagtcttgtaacggtttttgctttgtttgccattaagctttacaatattaagaaacggcataaatatgttaacatgaagggatatccgacatataaaacgaggtgcagacaaaccgttgaaaaaactaaaagtaatgaccgtattcggtacaagacctgaagcaattaaaatggctccgctcgtattagagcttgaaaaatatcaggaaattgattcgctggtgactgtaaccgcacagcacagacagatgctggatcaagtgcttgaagcattcagcatcacgcctgattttgatttgaatattatgaaagagcgtcaaacgctttcagaaattacatctcatgctttgctgaaactggacaagctgtttcaagaagtaaaaccagatatcgttttggtccacggagatacgacgacaacgttcgccggaagccttgccgccttttatcatcaaatcgccgtcggccatgtggaagccggtctgcgtacgcaaaataaatactctcctttccctgaagaaatcaaccggcagatgacgggcgtgatcgctgatgtgaattttgcgccgacaagccaggcagaacagaatctgcttgctgaaaataaaaagccggattctatatttatcacgggaaatacggcgatagacgcgcttcaaacgacagtgcgggaagactattctcatccgatttttgacaagctggaaggaagcaggatgattcttttgacagcgcacagacgtgaaaatttaggcaggccgatggaacagatgtttaaggccgtcagaagaatcgttgaagagtttgaggacgtacaagtcgtttatcccgttcatttgaatcccgcagttcgtgaggccgcagaagcccattttgctgattcggacagggtgcatttaatagaacctctggaggtcgtggatttccataacttcgctgcgaaagcaaatttcattttgaccgactcaggcggggttcaggaggaagcgccttctctcggaaagccggtcttggtgcttcgggacacaaccgagcgccccgaaggagtgaaagccgggacattgaagctggcgggtacagatgaagaaacggtgtatcagctgacaaaacagctcttaaccgatcaggccgagtatgaacggatgtcaaaggcgtcaaacccttatggtgacggatcggcctcaaaacggattgcggaagaactgctttatcggtacggctatagaaaaacccgtccgcagccttttacagaataaaaaaactctgcatcatatgcagagttttttattatttcaggctttcttttaattcttttttgactgaagcgaggcttgcttcatctaatttgtaataatagatattgttgattctcgttcccgttcccttcagttcatgctgagtgactttgctgcgggcatttttatagtcagtcataaccgtccacatatcatcgaatgacatgtttgttttcatattgttttcaatgaccttaaacatatctccgaatttcgtgacagacgagatgtttgcccccttagaaataatcccttcaatcacttggcgctgccgctgctgtctgccgaaatcccctcgggggtcttcttttctcatgcgggtgtaggcaagtgcttcttcgccgttcaggctgatgttccccgttccgaaagaatgcccgtcgtagttgaaggcgaacgtgctgttcaccgtaatcccgccgagtgtatccacggtatctttgaagctctccatgtttactttcacaaaataatctaccggcacgtcgagcaggtcctcgacggtatccgcggccatttgggttccgccgaaggcataggagtggttgattttatccatcgtacctttgccggagattttcgtatacgtatcgcgcgggatgctgaccatttccgttgtattcgttttaggattgacggtcatataaatcatcgtgtccgcgcgccctttgtcatttttccgctcatcgactcccatgattaaaacagaaatcggatccttctttccgagatctatatccgtgtcacgtttgtccgatttttttaagtcttcctgaatgcttgccaccgttgaagccgctttgtgccacaagtagtagacgtagcctcctgatgataaaactaacagcccgatgattgttacgattgtcagaagaacctttttcttctttctttttcgttcagctctcatttgtcatcaccttttctattaactttcatgatgcaatttactaatctttataaacccagtcatatttttacttataaccatgtaatagacgaaattcttaaaaaaaaggttacaaaaagaccttaaaattaccttaaaaaaaagttagtataagacgatacataaagatgaggtgaaaaaaatgaaaaaaactattgcagcttcgttcttaatactgcttttttctgttgtattggcagcgtgcggaacggcggaacaatcaaagaagggaagcggttcttcggagaaccaggctcaaaaagaaacggcatattatatcggtatggcggatacgcacacaattgaagtaaaagtggatgatcagcccgtcagctttgaattttctgatgacttctctgatgttctgaataaattcagcgaaaatgacaaagtcagcattacttatttcacaaatgataaaggccaaaaagagatcaaggaaatcgagaaagcaaaataatacaccatgatcagcaaaaggcgggataaaaattgaagaaaacaatatgggctgtctgtttttctgtgatattcagcctggctttattaccggaaagcacttttgcggccagttctgatatctcagtaaaactgacgaattatattggtaataaatcgactctgaatatcgaaccttcaggaacttataaactgacgggaagcgatgtgtcctccgttgtcagattgggaggcgcgtccaaatatgatacggctaacgccgcgacatctaagtattggaaaaacccgtccaacgtagtcgtcgtgaatacggacgcttattttgcggacacgctttccgtcattcctttagcgaataaactgaaagcgcctgttctgctgactgaagcgaaaaaactgagcagcagcacagaagcgcaaatcaagaaattcaatccggataatattttaatcatcggcgggacgaacagtatttcgtcagccgcggaaaagacattgaagaaatacggccgtacgaaacggatcagcggaaaaaacagatatgatctgtccaaaaatattgcggccgaaatgggcagctatgaccaggcggtcgtagtaacggggatgtatatacggatgcgctggcaatcgcgccatatgccgcgcaaaacggctatccgattcttctgacgaaaaaagactcccttccgagctacaatctgcctaaaaaagtgatcatcatgggaggcacttcaagcgtcagcaaagatgtggagaatcaaattaaaaagaaggcctcggtcaccaaacgaattaccggatcaaacagatatcaaatatcagcaaacgcagtcacttcgcttggcatggatgcaagcaaaacggtggctgccaacgggactaaattagcggacatcgtagtcggatcaaatattgccgccgcaaatcacatgccgcttgtatacatcaaaaaaagcgaaacacccgccgacgaggccggcctttttaaaacgaaaggcacctattcttatacattaataggcagcgcgaattcaattgccgattcagttaaggctgcttacgcaaaagagttttatctcgtaaacggaaagacgtaccgtattgaaacgtccggcggcaaattaggcgttgcaggcattaacagcggaaaaacgtctttcaaggcggttcctgaaaaatattcaacagcaaacacaatcagcattgacgggaagccatatctggggaatatgagtttcactgctgaatccggcaaatatgtaagacctgttaatgaaaacattccttttgaggattatctgaaaggtgtcctgccgaatgaaatgccgggaagctggccgacagaagcgctgaaagcccaggctgttgccgcccgcacctactctatcggcaagatgggacaaacagtcgcggatacaacggcctttcaggtttacgggggatacagctggtatccaaacgccaccgcagccgttaacggaacaaaagggaaagtgctcacttattccggcagattgatagatgccacttactcatcaagcaatggcggttacatggaagccggcgatgaagtgtggggatcgaaagtgccgtatttagtagccaaaaaggacacaaaagatcccgaaatcagctggtctttaacattgcagaagcagcagctgccagcgggtctggatatgaaaaatcccgcatcctggtggtctaaaacaaacgaagcaaatgctgcgcagctcaacggaataaaaaattggctgatgaaaaataaagaaaccaatgcaagttccataaaaattgcaagtatctctgatctctcgctcaccggaaaaacaaaaggccagcgcgcggaagacgccgcggtgaaggtcacgtaccatgtgaatgacaagtcgaagggctatgtcatgaacaagactgcatctgttgaggtgaaagcgtctgaacttaggacgatgatcggagcttcatcttttaaaagcacatacgccagtgcgtccggtaattcttcgcaaatcacgatatcaggaaagggatacggtcacggcgtaggaatgagtcaatacggagcaaaagaaagagcggaggccggagagccgtatacttctattcttgcgttctattatcctaatacagcacttacaaactactaaacttctgtggaggagatcggattgaaattcatcataaaatgtctccccgtctttattctcggggtcattctatttgtcccttccgctttggctgacaacacggttaaaaggatcggcggaagcacccggtatgatacggctgtactggcggcaaaacaatcatggggtgaagcgaaaacggtaattatcaccggcggaacttcatatgccgatgcaattgccgctgcgccgcttgcatatcaaaaaaatgcgccgctgctgtttacaaataaagatcagctgtctgccggcacaaaaaagggattaattgatttaaaaacgaaaaatgtgattatcgtaggcggcacacctgccgtttcgaaaaataccgcaaatcaaattgctaaattaggcatcagtgtcaaacggttatcagggagcacgagatatgccacagccgcaaaagtggcgggtgaaatgacaagatcttctacagcccttgtggtcaacgggtttgttgatgcggatggaatggctgcgatttcttatgcgtccgctaaaaaatatccgattttattcactaatgattcaacgttaaatggttctgcgtccaatgcgatcaaaagcttagggattaaaaacacgattgtcatcggcgggacaagcagcatcagcagctcactttataataagctgccgaacccttcgagaatcagcggcaaaaaccgctataacctgtctgtgaatcttgcaaaaaagacaggcttaagcacaggctatacgtttgttaccaatggctttaaagaggcggataccatcgtcggaggcgtgctgagcgccaaacagggaagagttcacctgctgacgaatggagacagtctgtcaaaagacgtccggacgtatatcggaagtaaaaacatcaccagcttcaccgtcataggaagtgcttcatctttaagcaacaatgccgcgtcgcagcttaaaaatcccgttgtcggcaaaacggtctttattgatccgggacacggctatcaggattcaggtgcaaccggaaacggcttgcttgagaaaaatgtaaaccttgatatcgctacgcgtcttaacaatcaattatacggcgcgggcgcgcttactgtaatgtcaagaaagggcgacacctttgattcgcttgaggagagagtgaacaaaggggcgaaggcgaacgccgatattttcatcagcgtccatgcaaatgcgaatgataacagcagtgcaaacggtacggagacgtattatgataaaacctaccaatcggcaaacagtctgaggcttgcccaaaatattcagccgagaatggtttctgctctcggcacgcgtgaccgcagtgtgaaaactgccggattttacgtcattaagtattctaaaatgccgagtgtcttgttagaaaccggttttgtcacaagcccgattgatgccaatattctaaaacaatcaacgaaaaaggacagactcgcggcggggatcacccaaggcgtttcctcctatttcagataatttttttcatggaaacagaccggttcataccggtctgtttttttattttttcattatgctttgtctcaaatatggatatgaatagatttacaataaaaaaacaataatcgaaacattctaataaacattaacgtttcctttacttccaattaacatccatctgctaaactcacggcataggtcatcaaacatcccaacaaatcgtgaggtgtgtgtcagtgggagcagagaaaagcatgaatgtaaataataactatgcagtgcggcaggggacttccgctgccgttacggaaagaacggcccgttatttggcttttaagcgattcatggacattgtgtttgcgcttgcggggcttttggcggcgctcccggtgatgggcctgttctccatactgattcgtttggagtcgcccggcccggctttttacaagcaggagcgggtaggcaaagacgggaagccgttttatttgtataagctccgctctatgaaaatagatgctgaaaaatcgggggcggtctgggcgctgaaaaaggatccccgcgtgacaaaggtcggcgcttttatcagaaggacccgtattgatgagctgccgcagctggtaaatgtgcttcggggagaaatgagcctgatcggcccgcgtcccgagcgtcccgtgtttacggaacagtttcaggctgagattccggggtttacggagcggctggccgttaagccgggattaagcggctgggcgcaggtcaacggggatatgacatgacaccgagggaaaaactgatgtttgacttatattatatccgcaacctgaccttttcattggaactgaagattatgctcaaaacgtgcaaagtgatctggaccggtgacggggcgcgataaaaattctggtcagcagacaaaaaagtagggaaaacgatgcctagtattacaaatcaaattttgagcggcgccaaatggacaagtatttcgacagcgtgtattacggtcattcaaatcgtccaattcgccctgctcgggcgggtcatgtcactggctgaattcggccttgtcggcatgatcacaacggtagtggtgtttgcccaaattgcgcttgatatgggttttggcgccgcgctcattcaaaaagatcatgtgactgataaacagatgtcttccttgtactggctgaatatcataacggggcttgcgctgtttgcgctgctgttcttcagcagtccgctcattgccgatttttatcggcgggaggagcttgtctatttaatccgcgtgctggccgtcatgtttttaatcgcgccgatcggtcagcaatatcaatatatgctgcaaaaagcgctggcatttaacacgctaagcaagattgaaatcttttcaaatgtgctgtccttcgtttacttggcggctgcggttttttatacggacccgattctcgcctatgtgatttcccaggtgctgctgcaatcgtcaaaaggtattctgtactgggtgtcctgcagaaaaacatggagaccggtgttcgtttttgatctgaagggaatgaaaggcttcttttctttcggagcctttcagctgtcttcccggcttgtgaaccggctcggggcgaatattgatatgattctgatcggcagttttatcggcgccgaggcgctcggcatttacaatctggcctaccagattgtcacgcttccggtattaaaaatcaatccgatcattacgagagtcgcgtttcccgtctttgcgaaaaacaagcatgaaaacagcgtgatcagagaaggttttctcaatatgaccaaaatactcgcgctgatatcctttccgcttttgctcggtttggtttcagtatcggatgcattcgtggcttcggttttcggagaaaaatggctggcggctgtcccggttttaaacgttctcgccatcgtcgggattttaagggttctgatgaatccgaacggatctgtgctgctggcaaaagggcgggccgatctggcattttattgggacgccggggtgatgctgctgtatggtgcatctttgtacgccgccgtgctgtccggaaatctcttgacggtagcctggacgtacgctttcatcagcatcctgaatttcctgatcgggcgctggctgctggcatatgtcattaagctgcggctgtcggcttacttcaaagccgtggccaaaccgtttctgcttacggcggcaatgggtgtcatcgcctttacagccagcttcgggacggagcggatcagccttgatgtcaagctgcggctggcgatctccgtatcctgcggagcgttgtgttatttgttcctgttaggaaaagcttatccgcatatgaaaagtaaattaagaaaaggacgtttgctatgaaggtattgtggatgacaagtgtatatccgagcagtgagaagccgggagaaggcgtttttcatgagacgcaggcccaagaactgagaaagcttggcgcggagatgactgtcatttgtccccggccgaaactcgccgcgccattccgggtgctgaaaaagacgtatcggcaaaaggatataaggccggcgcatgaatggcggaaaggcgtgtccgtccaccggccgttttatcaggcggttcccgggcagctgaaatgggcgcagccgcataaaagaatggcgtcatcggttctttccgaaattaaaaatcatggcctgaagcccgatctgattcacgcgcatttcgccatgccgtcaggcggagcggccgccattgtgtcaaaggctttaggcatcccgtatgtgctgaccttgcatggcagtgatgtcaatgtctatccgcattacagcaaaagcgctcatcgcgcatttacatttgcggtgcgggaagcagccgatatttacgctgtgagcggcagtctgcgggaacaaatgaaaaagctcatcgaagcggagtgcagcgtgcttccgatcggcatcacgcttgacgccttccgaaaaaggaacgagacgaaagaagccgtcagaaaacggctcggccttcctccggataaaaaactgatcgtgttcatcggcaggcttgtcaaagagaaaggtgttttcgacttatcaaaagccgttcagtcattggatgaaagatatgaagctgtctttgtcggtgacggtccagccgcatcttcattgcgtgaagccgctcatatcgtcacggggcaagtgccgaacgacaaggtacaggactatctgctggcctcggatgtaatggcgctgccgtcctacagcgaaggcatgccgactgtggtcattgaggcgctcgctctgaaggtgccggtgatctgtaccgatgtcggaggattggcttctttatttgggaaatatagaggtttgctgatcaagccgggttcacctggcacgctggcagaatccattctgcaatatgacgaaggagaggcttggacgccgcaaacagccgaggaactttatcaaaccgtccgcacgtattttgacgcaagccaaaacgcgaaagcgctgaaagagaaataccggtccgtcatgaaccggtccgggcaagaggagaacctttcgaaagagggatgaagctgtgaaaaaaatcgctgtattaggaacagggtatgtaggtcttgtatctggaacttgttttgcggaaatcggccatcatgtgacttgctgtgacatcaatgaagcgaaaatcagaagcttgcaaaacggagtcatcccgatatatgaaccggggcttgaggaattagccgaaaaaaatgtcagtgacgggcggttatcctttacggccgatattgagccggctgtgaaagccgctgatatcatctatatcgccgtcggtacgccgatgtcaaagacgggtgaagccgatctgacctacattaaggcagcggcgcaaacaatcggagaacagctgaacggatacaaaatcattgtcaccaaaagcactgttccggtcgggacgggaaagctcgtttaccaaatcgtcagcgaagcgtcaaagggaacatatccgtttgatgtcgcgtcaaatcctgaattcctccgcgaaggttcggcggtgcgggatacgatgcagatggagcgggcggttatcggcgccacaagcgaacatgccgcttcggtcattgaagagcttcataagccgttccgtacgaagatcgtaaagaccaatcttgaaagcgcggaaatgattaagtatgccgcaaatgcttttttagccgccaaaatatcttttattaacgatatcgccaatatttgcgaacgtgtcggggcggacatttctcacgtgtcagaaggcgtcggtcttgacagccggatcgggaataaatttctgcaggcgggcatcggattcggcggatcctgctttccgaaggatacaatggctttattgcatatcgcaaacgccgccggctatccgtttgaaatgatggaagccgtcattgaaaccaatcagaagcaaagggtccgtattacggaaaaattgaaccgcgccatcggtcccttaaaagggaaaaccgtggccgtactggggctggcctttaaaccgcatacaaatgacgtccgctccgccccggctcttgatatcatcacaagtcttaaagagcagggcgctcacgtgaaagcgtatgatccgatcgcgattcccgaagcggcagcgatattaggagaaggcggcattgaatatcacgcagagatgtacagtgccatcaaaaacgcggacgcatgcctgattacaacagattggccggaagtcaaggagatggatcttcagagagtgaagcggctgctcaaacagccggtcatcattgacggcagaaatatgtttccgttggagtatatgagggtttcaggattcacttatcattccgtcggacgtccggcggttcatgccgatcggcaaataaaagaactggcaagatagaaaaagatttgtcttcaggctctcggcagcccggctcggctgccggttttggaaaggggtttgccatgtgagtatcaaacgttcagcggcacatgttcttgtgctgcttgccgctgtcattacaggaggattcatcatgctggaggcggtcagggcggatgccggcctcggaaaaatcaccgtgctgctgcttgccgccatgatcggtattgccggacttgctttgctatccgcctttacaacaaacggtcagatgtttatggggctcatttatatactgatcgcgtgtacatttttaaaccaggccttctttgcggttcatctcggatttttcagcttatttatataccggctgttattaatcggagcgggcgccctacacatcgccggcatcctgacaaaccgtcatcatattgacagatggaatcgggtgaatgtaaaaggggttctgatgtttttcgccttatggtttacatacggtctcctatcgttattgtgggcaaaatccgtgacgtacgggattaaatatttagctttaataggaatgggcatgtttttgatttatcttattgtcatgttcattcagcgctttgatcagctgatggttttttacggcatatggcttgtgatgaccatttttgtgatggcgatcggcttttacaaccattttacacacaaccatctgccgagctccacgctttataacggcccgcagtacaaacagcattatccgacgtccgttttctttaatcaaaatgatttcgcgacgtttttgtgcatcagtttctttctgtatgcggcggcggtgaaaaatatgaaaaacggctatgtgaaggccgtcagcctgctcttagcgatctgcgctttgtatttaatcattttgaccggttcgcgcgcgagtctgctgggcatatgcgcgggggcggctgtatacgtcttcatcctgctgccttctctgttgaaaaaattcgcgctgtacgctgcgggagcgggtgctgcgctgtttgcggttttatttgcgggccgtatcaccaatgccgtcttgaatctgttttcagctccgcaggcgatgccgggacagcagccgcttccttccaacctcgccagggcgaatcttttaaagaacgcctttcactatgtaattgattcctgggggtccggagtgggtgccggaaacgtctcttactatttaaaagcggagcccgtttatgatacgggcggcgtagttgaggtgcacaactggctcgtcgagattatggcgaacttcggcgtacttacgatgctcggttacctgacagtctatttgttccttttttggacactttataaatgtcatgaaagaaaatcggaaaatcagtcaagactgatcacagaaggacttatcacggcgatggccggttttttggtaagcagcatcagcccaagctccgtatcgaatttatttttccactgggtatttctctcgctcgtgatcgcggcggtcaatatattgaggcgtttacaaaaggagcctgccgtcacggcgtactatgaaaaacagggagatgcgagatgaaggatatgttgacaagaataacccggcgtatcaaaaagaatatcatttggatcattgcgctgcccgttgtgttaggggcggcgggatatgtattgccgtcaaaaatcagcggaaacagcagttttacatcagaagccgcgatcgccgcgggaaattatgatcatccgctttataacaatacaaaagaaatcccgctccttttgacgagcgatgcctttttaaagcaggctctgcctcataaaacagacgaagaaagagcggccgtgaaaagtaaactgactgtcgaaacacaatcagattcattgatcacggtcagctgcagcggccaaaacaaacaggaaaccgaatcggtgtttcaagccgtcataacaacttttctgaagaatgatcaggacctgtttgaaaaacgggcaaaagtagtgcggcagagtattgctgcgcttgaaggagaaaccgtcagcgcggacgccaaagtggataaggaacgatttttatacgaattgaaaaatacgcagctgaacctgaaagcggccggcgtcatcaattcagagccgatgaatgaaacggctggtcaaggcatgccgccgaaaaagaaagcggttctgggcgttttaatcggcattgcagttgcctttatgttcattgtcattcctgagttttttagagagtccttgtaaaaatctgcgatggagatgtgaccatgacaaactggaaacctttcgtatctgtcattacaccgtcttataacgcaagtgaatatatcgaagacacgattcagtccgttttacaccaaagccacccgcattgggaaatgattatcgcggatgattgttcaacggacggaacgagagatattttacggcaatatgaacaaaaagatgagcggatccgcgtcgtttatttagataaaaacgggggagccgcagctgccagaaatacagcccttaaacatgccaagggccgttatgtcgcatttctggacagcgatgacagatggaaaaaggaaaagcttcaaaaacagcttgcgtttatggcagagcggtcctgcgctttttcatttacgggctacagcgtcatggagcaggacggaacgccgacggacaaaacgattcaagcccctgaaagcctgtcatatgatgaagctttaaaaaacacgattatcggatgtttaacggtcatgattgacagagagcagacggggcagattcaaatgcctgatatcagaacgcggcaggatttagcgacatggctttccctgctgaaaaggggatttacggcttacggcctgaatgagtgcctttcagaatacaggcttgtgcagaattcgatttcaagcaacaagtggaaagccgcaaaaaaaacgtggtttgtttatagagaaattgagcgcctgcattttatcaaggcttcgtggtgttttatgcaatatgcgaaaaacgcggtcttgaaaagactgtaggcgtcagaggagctgggtgatgaaggtggaaccgattattcacgtaatcgtcggagcggcggaatgggggcatgaccggctgagatacagacggcatcggctggctgaatttcttgcccggcaaaaagaaacgaaaagcgtcatttgggtatgcccgtccccgcgagccaatgatgatcagatggccgggatcgccgagggaatccggcagttcactgtaaaggatctcatgcagcaaaaagcattccgtttcggcaggtatacagacatgtgttacaggcataaactttcaccattgttgcacatgctgaaggaagaaggagaaggggcccgctgctgcttatggtacaccttccccggtttcccgcttctggcagatctgtttccttgggatgaagtgatttacgattgcagtgatctgtgggccgctccgatcagcggccgggccggtgtgctgtcaaatgtaagaagaaacatcattaaacaggcggaaatgagaatcattcagcgtgccgattccatcacctgcacatctgactgtctgcaccgggaggtcggaaaaaagctggagaacccgcaccagaaagtgttcaccattgaaaacggagtggaatatgacctgttttcacgggaaaataaacagccggatgaagacattttacggggacgaaacggaacggttctcggttttatcggcggaatcaaaccaaagctcgattttgcgcttatggcggaaacggcagatttgcggcctgactggacgattttattggtgggcccgaacacggctcaggacgatccggatttcgagtcgcttctggaacgcccgaatgtcatctggacgggacctgccgcgccgaatgaagtgccgtcctatatgcagcttgtcgacatcggcatcatgccgtataaaaattcaccttataatgacgcggtatttccgcttaagctttttgaatttttagccgccgggaaaccggttgtcggctgcaacctttcttctacgtcaaaaatcaaaaggccttacgtttatgaatacgttgaagggagcgaccccgcagatttcatcgcggcctgcgaagcgcttctggcagcggaccgccgcggatcatacgaggctttgcgccgtgaattggcccggggacgggattggaatgttttattcggccgaatgcttgaatgcacgggtatattggaaaatgcgcaatcccattaaaagggaaagcgcattttttgatttgcgtgtttctttttgatgatgcttgttataataactagtaagaattataatggaaggaacggttcaatatcagaaaagacttcatataattccaaaggagacttctttatgcttgacgaacgcatgtttcgcatagttgttgcgttttttgtctctctgctaacggttttaatcctaactcctatcgtaaaaaaaattgcgatcaaaataggtgcagttgaccagcccagcaaccgaaaagtacatgataaaataatgccccgtatgggcggcttggccatctttatcggcgtagcggcgggtgtgctcgcggccggcatatataatgaaacgaaaatgaccgccattacggtgggtgcgtttattattgttattttaggaatccttgatgataaataccaattaagcgcaaaggtaaagtttttcgtccagctggccgtggccattatgattgtgagcacgggactgaaaatggactttttctccgtaccgtttttaacggaacgtttagaattgggatgggtcgcttacccgctgactgtgttatggatcgtcggtattacgaatgcgatgaacctgattgacggtttggacggactcgctgccggcctgtcggtcatcggactctccactatcgccgttatggcgttgtccggagggaaaatccttattctgtcactttcacttgtcgtgataggaagcacactcggatttttattttataattttcacccggcaaagatatttatgggagataccggatcgctctttctcggatacgtcatctcagtactctcattattaggtctttataaaagtgttactttattcagtatcatcattccgatcatcattttgggcgtgccgatttttgatacgacattcgccgtcatcaggcggattttaaacaaacagccgatctcagcgcctgataagtcacatatacaccaccggctgatggccttcgggctgtcacaccgcacggctgtcattatcatttatttaatcggctttattttcagcgtcagtgccatcctgctgaaaagcgcgaccatttggctttcgctgtttattatttttgtattgattgtatttatgcaaatcatagcagaggtcacagggttagtaaatgaacaatttaaaccatttaccaagttttacaaaagattggtaaagaaaaattaaaaagagcagatcatgcgaatggtctgcttttttgctattctcttattatatagaaaaacccgatcctgctcaaaggatcgggtttactcttaatagcctgttgtgccgccggactgtgtgctgtccgtaccgtttgcacctgcagtaccgttggttgaatcggttgtgccgcttgttcctgtgctgccggaagtcgaatcagccgtaccgcctgttcctgtgctgccggaagttgaatcagtcgtactgtccgttccggtgctgtcagaagcgggatcggatgccgtgctgtttccggacgggtaatccaggtgcttctgcaattcctgccgtactttctcgagattggttggatccggctggaaataatatgttccgcgcgtagttgcggttccgcctaaatataaatctgatcctgttatggtcagtgtatcaatctttttgctggtaaatccgctgtaaatctgctgaagagcgagtccttcagtgattcggatattcgtttggacattattgctcgctgtttcagcgattttatcgattttagcaatatttccagctctggacatttggtcgatcagtgcgtttaaaatttgcttttggcggtcattccggccgaagtctccgcgcttatcctgctttctcatccgcgcgtaagccaaagcctgctcaccgttcaaatgcatgtttcctttcttgaaatagatccgtttctttttactgacgtcactcatctcgtcgaagtcaaacggcacttttacatcgaccccgcctacttcatcaataacatccttaaagccattgaagtcgacagtgacatacttatcaatcggtatgcctaataagtcttcgacggttgagacggtttcatccgctccgcccttagcaaaagccgcattgatttttgttttgttgccggttgtgtcgccggcaagcgtcacccgcgtatcacgcggaatactcagcattttcattgttttatttctcggatcaagggtaacgacaataagagaatctgatcgtccgccttttccgctggtggcataattttcgatccccataaacaaaatggagaacggttttttcttcatattgatgactttatcccgcaattttgatttttctccgcgggaaagggcatcatatgcattatctgccgcattgatcgttttgtatactttgtatccgccaaatccggcagcaactaacaaaacgagggtaagcagcagcaaaatccgtttgaatatgatctttcgtttgcttttctttttctttcgaacacgcactcttacacgttcagccattacattagtctcctttagggctgacgtctgtttctaaatacgtcagttctccctctgtattcttactcttgccgttcgtcagttctgtcatccattttagaaacgcttctttgtctttttcttcaacgtacgtttcaaattcgacatgatccgcataatggatatctttcagtaaaaaaactgattctctcagttcgttctctatcttgccgagccacgtataatccgctgatgtatgcataatccgcatcagcttccgctccgtaactcctatatgatttaagccttcagacactgacttcccatatgcacgaatcaatccgcctgcaccgagctttattccgccgaaataccgggtaaccaccgcgcaggtatctttcagaccgcgttttttcagcacttccagcatggggacgccggctgtgccgcttggttctccgtcatcattggccttttgtatatggtcggtttcgccgatcagataagctgagcagttatgagtcgcattccagtgctgtttttttatcttttgtataaattcctgcgcttcctcttcagaagcagcacggctcaggtgacagataaaacgtgatttttcaatcacaatctcatgttcacccgtttctttaacagttaaatagctgtgcagcatgattgctggaccctcctgacaagcattaaaagacttgtttctacaaattcgaacagactttagaatttttgcgcatattttggtatcatgaaagagtaagatactatataaaaatgtttttttctagaatatacgcattctttcattataattcgacataaattgcagttcaattacatttataataaaaatacataacaacaccgttacggagggagacagatgaataaatcgaagatggactccaaagttttggattctatacttatgaaaatgctgaaaaccgtggacgggagcaaggacgaggtttttcaaatcggagagcagtcgcgccagcaatatgagcagctggttgaagaactcaaacagatcaaacagcaggtgtacgaagtcattgagctgggggacaaacttgaagttcatacgcggcacgcacgaaaccgcttgtctgaagtaagcagaaatttccataagttcagcgaagaagaaattcgcaacgcctatgaaaaggcgcacaaacttcaagtggaactgacgatgatccagcagcgtgaaaagcagctgctggagcgcagagatgatttagaacgccggcttttggggcttcaggaaatcattgaacggtcagaatcattggtcagccaaataaccgtcgttctgaattacctgaatcaagaccttcgccaagtagggcttcttcttgccgatgcgcaggctaaacaagatttcggcttaagaatcattgaagcccaagaggaagaaagaaaaagagtttccagagaaattcatgacggtcccgcgcagatgctggcaaatgtcatgatgagatcggaattaattgaacggatcttccgcgaccgcggcacggaggacggatttcaggaaatcaaaaatcttcggcagaatgtgcggaatgccctttacgaagtcagaaggattatatatgatttaagaccgatggcattggacgatctcgggctgattcctacactgagaaaatatctttatacaactgaagaatacaacggaaaggtgaaaatacattttcagtgtatcggagacacggagaacaaaaggcttgccccgcaatttgaagtggcgcttttccgtctcgctcaggaagccgtcacaaatgcactcaaacattcagaatcagaggaaataacagtaaaagtggaagtaaccgctgattttgtcgttcttatcattaaggacaacggaaaaggctttgatattaaggatgctaaacaaaagaaaaacaagtcatttggcttgctgggaatgaaagaaagagtagatctgcttgaaggaacgataacgatagactctaaaataggtcttgggacatttatcatgattaaggttccgttatctctcggcctataatttgttaaatagagccaaaagacatattgaccgaacagcggcgtatatagaacaataggataaggaggcgtagcgtgtgactaaagtaaatattgttattatcgacgaccatcaactattccgtgagggtgtaaaaagaatattggattttgaacctacctttgaagtggtagcagaaggtgacgatggagatgaggcggctcgaatcgtcgagcattatcatcccgatgttgtcataatggacatcaatatgccgaatgtaaatggagtagaggctactaaacagcttgttgagctgtaccctgaatctaaggtgattatcctctccatccatgatgatgaaaactatgtgactcatgctttaaaaacaggtgcaagaggctatctcctgaaagagatggacgcagatactttaatcgaagcagtgaaagtggtagccgagggcggttcttaccttcacccgaaagtaacccacaatcttgtcaacgaattccgccgtcttgcgacaagcggagtttctgctcatcctcagcatgaggtttatccggaaatccggagaccattacatatattaacgagacgggaatgtgaagtgctgcaaatgcttgcagacggaaaaagcaaccgcggaatcggtgaatcattgtttatcagtgagaaaacagtgaaaaaccacgtgagtaatattttgcagaaaatgaacgttaatgaccggacacaagccgttgtcgtagccattaaaaacggctgggtagagatgcgttagtcatgtatgagaagacttgccataataggcaagtctttttttacagcttcatatctattaaaatacttattaagtacttaataaggcaggtaaagtgatgaagattgcagttgtaacagacagtacagcatatattccgaaagagatgagagaagaacatcatattcatatgattcctcttcaagtggttttcggtgaaaaaacattccgcgaagaaacagaactcgactggagaagtttttataaagaagtaaaaaatcatgatgagctgccgactacgtcccagccttctttcggtgaattaatcgcattgtacgaagaactgggcaaaacatatgacgcagtcataagcatacatttgtccagcggaatcagcggaacttataacagcgccgcctcggcaaacactatggttgatcatattaaagtttatccctttgattcagagatcagctgtttggcgcaaggtttttatgcattaaaggcagcacagctcattaaagacggtgttgactcaccggaagagattattaaagagctggaagaaatgaaaaaaacagtccgtgcgtattttatggtggatgatttatcacacctccagcggggcgggcgtctaagcagtgctcaggcttttatcggcggtctgttaaaggtaaagcctattcttcattttgacaataagataattgttccttttgaaaagattcggacacgcaaaaaagcgatttcgagaatttttgaactgtttggggaggatgcaagtaaaggaatcccgatgcgggccgctgtcatccatgcaaacagggaagaagaagcggcggatattatacaggagttaagcggtaaatatcctcatgtcgaattctataacagctatttcggtgccgtgatcggaacccatttgggcgaaggcgccatcggaatcggctggtgctttaaaaactaagtgaaaatctccgttttcaagggcggagatttttttattattaaattttcgtgattcgacaaaaaaattcccggcaggcatactttgaacagaaaggaggcagggagatgtccgaaggtgcttcagaattttcagaggtgcgggatttcttttacggccggcatttattgagatctgagataccgttttcagatcagcgcatcaaccgttttatagaaaaagagcatataacggccgagccgtcaatcatccgccggaaaaaccgttacgtctgccaacgatgcggtcagtctgatcaagcctgctttgcggcattttgggcgccctctgccaaaaggcagattacctattgccgtgcctgtgtcatgatgggaagggctgatgaactgacatcattatattcttggaatcaagcccctgaaaacagctgggagcctgtaaagctttcttgggaaggaacactgacagacggacagaagcaggccgccgccgcgcttacagatgcgataaaagagagacaagagctgttagtatgggcggtttgcggatcggggaaaacagagatgctgtttcctggtatcgagtttgccctgaatcaaggtttgcgcgtctgtgtcgcgactccgcgtacagatgtcgtacttgaactgctgccgagactgaaaaaagcatttgagaaagtcgacgtttctgctttgtacggcggcagcgaggacaaaggccgcttgactccgctgatgatttcaaccgctcaccagctgatgcgctaccgagacatttttgatgtcatgataatagatgaagtagatgcgtttcctttttcagccgatgagacattaagattcgctgttgataaagcgaggaagaaaaacagcgcccttgtttatgtaacggcaactccttcagacacattaaaaaagaatgctgaagccggtttgctgaaaagcgttcgcataccggccagatatcatcggaaacccctgccggagccgcgttttttgtggtgcggcaattggaagaagaagcttcagaaaggaaaactgccgcgctctgtaacggattgggtccgccaaaaacttcaatcacagctgccggttttcttattcgttccgtctgtacacgtattgaaaaagacaacggattattttcagaaattaaacatacgggcagaaggcgtacatgcggaagacacattcagaaaggataaagtgaaacgattcagagacggccggcttgatctgctggtaacgactacgattttagaaagaggggttaccgtgcccaaagttcagacatgtgtcctcggcgcagaagcacctatctttactgagagcgcgctcgtacagatcgcgggcagaacgggaaggcattataaacatttcagcggtgatgtcgtcctgtttcatttcggaatgacaaacggaatgaaaaaagcaaaaaaacatatagaacttatgaacaaattggcacaaaaaagtaaattgttggactagttaatttcagaaaacatgatacagtatactcatactttcctatgaggagctgtcagcatgcttgtcaattctaaagaaatcatattaaaggaacttctcgaccgccatatgcctaagcttcatatgaaatgcacatgccgggtatgcaaaaatgatgtactggcactttcattaaaccgggctgagccggcatatgttacagataaaaagaaagttgcttatgcaaaagcagagatagttgataaacagaaaaatacggcgctgcttgtcattctggctgaatcagccgcgattgtttcggttaatccaagcgagttctgtgaaacttgggaaggagcgtaatatctctgaattgtttattgtgtgactcaccaatttcaagttcattgacttggagatctttgttttctctggcgcccgagcaagaggtatgcaccatatgcagcagccgattcgaaaaaattgaaggccccgtatgcagtatatgcgggaggcctcaggagtcaaatgaaaaatgcgctgattgtgcggcccgggaatcaaaaacggaaaagcgctttttgctgcggcaaaaccgttcggtatatttgtataatgatgcgatgaaggactcattagcccggtttaaattcaggggtgatgcgaaaatcattcaagcatttggacgtgactttgctgccggctttaaagcggcatatccatcaaatacacatactctcatccctattccgctgagcggcgaacggctggcggaacgcggattcaatcaatccgagctgctggcctctctgctcggaatgcccgtcattttccccctcatccgactgaacaatgaaaaacaatccaaaaagagcaaaacagaaaggctgtccgcagaaaaaaagttttcagcagccgaaaactcggccgaaggtatgaacgtcatcttaatagacgatatttatacgacgggcgccacactgcatcaagccgccgaagtcctgctgacagcgggtaaagcgtcatcggtctcctcttttactttaatcaggagctaaatcattctttttttctgccgatataattgatagaaatataaggcagattaaagaaggaataggagttaatacgatgggtgaattggcgaattgtccaaaatgcaatgctttattttttaaaacgaacctgcagaccgtgtgccaggcatgtattaaagaagaagaaaaagcatttgaaaccgtctataattttttgagaaagcagatcaacagacagtcgacgatgcagcagatcactgaggaaacaggtgtggatgaagagctgatcctcaagtttatcaaacaaaaaaggattcagatcagccagcttccgaatttggcatatccttgcgaaaggtgcggaaatccgatcaggacaggaaaattttgcaagtcctgtcagacagatattgagtcgcaattagaccatatgaaccaaaaaacagccgctgaattcaaagaaaaaaacagtacaaaagacacatactatgcctataataccaaaaacacctgattccctaaactaactgataacgcagtcgataaaagaattagactgcgaacagaaagcgagaggaatcctatgaaaatcaatcagtacggaacacaatccgttaatccataccaaaaaaattacgaaaagcaagccgtacaaaaagaggctgcaaagccgaaggacaaagtggaaatttcttctcatgcaaaagagcttcaaaatgcgtcagatgcggtcactaaaacacgtcaggaaaaaatcgctcagcttaaagcggatatagagagcggaacatataaaatagattcaaacagcatcgctgaaaacatagtgaatttttataaaaagcaataaaaaggagaaagtcaatgtctgcaaagccaattattgatcaactgaagcgactttgcgcactgcatgaacatctgctcacgctgtctgaggagaaaacggaagcgctgaaagcaggtaaaacaaaagagctctccaacatattgactaaagagcaaaagtatattcaggcaatcgggcagactgaggaagaacgaatcaggttaacttctcagtttctcagccgcggtgaggacaatacaattgctgcatgcatctccagaacttcaggcagtgaaaaacaggagcttgaagggttatttcactctctgtctgcgcttcttgaccgtctgaaagaagtgaatgagatgaacaaacagctcacgattcaggctttacaattcatctccggggcattcgatatgatcatgccgggtgaaaaagagaatatgaattataaagagccgcaagcggcgcgcaagcctgtcagccgtttgacattattcgattcaaaagcttagaacggaggattttcaatgccatcgacttttatggggctcgaaacagcaaggcgtgcattgagtgcgcagcagactgcattgagcacagtttcaaataacgttgcaaatgcaaatacagaaggatatacgaggcagcgcgtcacattacaatcgacgagcccttatcccgcagtatcaaaaaacagtgatctgacggccggccaaatcggaacaggagtaaaagccggttcagttgagcgcgtcagagacagttttttagactatcagtacagaacggaaaatacaaaattagggtactatacagcccgttccaattcattgtcgcaaatggaaggcgtcatgaaagagcttgacaataacggattaaacggatcgctcagttcattttggaatgcccttcaggatctggcgacgaatccggaaaatacgggagcgcgctcagttttgcaggagcaggggaaatctcttgccgaaagttttaactatatatctacctctttgactaacattcagggtgatattaaaaagaacctggataacacagctgatcaggtcaattccattctcaatcagctgaatgaccttaacaatcaaatagcggcagttgagccgagcggtatgctccctaatgatttgtatgaccaaagagacagattgattgatcaattatcttctatggcaaatataaaagtttcatataataagtcgggcggacatgccttggcgactgctgagggcacggttaacgtcgaattgctgaacgggaacaacaattctctcggaacgctgctcgacggtaacacaaaaacagtttcagaaatgaaaatcaactacgacaaggacagcggactcgtgtcgagtgtgtcagtcggcagcagtacggtcaatgcggatgcatttaccggaaaaggctcacttttaggtcttattgaatcatacggctatatgtcaaacggagaagaaaaagggctttatcctgaaatgctgacggctcttgacaatatggcgctatcctttgctgacgcgtttaatgcagttcatgaaaaagggaagacctatacaggcgaacagggtgcagcattttttgatttcagcggtgatgaagcggtgccggcaaaaggtgcggcagcgaaaataaaagtcagtgacaaaatccttgcgtctactgataatatcgcagcgtcgttaaacggagaaaaaagtgacggcacaaacgcgacaaatcttgcagccgtacagaacagcaagctgactattaacggtgaaaccactacaattaatgacttttatgaatcccttatcggaaagctgggcgttaattcacaaaaagcggctaatcttatgaacaactctgaaagcaacaccctttcagccgatgaacggagacaatcagtcagtgcagtgtctttagatgaagaaatgacaaatatgattcagtttcagcacgcttataatgcggctgcgcggatcataacgatgcaggatgaaatattcgataaaattattaacggtatgggcaccggaggaagataggagataagtaaatgagagtaactcaagggatgatcgcaaaaaattctcttcgatttatcggctcaagttatgacaagctcgatcggcttcagcagcaagtgtctacggggaaaaaaatcacgaaagcttctgatgatccggtcgtcgcaatgaagggaatgcagtaccgtactcagcttgcgcaggtaaaccagtaccaacggaatgtttcgcaaggttttacatggctggaaaactcggaatcaagcgtaaactcggaaacggatattatggggaaaatccgggacttgatggttcaggcgaaaagtgattcgaacggtgaaacagaattgaaagcaatcggtacagaaatcggccagctgaaaaagcagctcgtttctgtcgcgaatactcaggtaaacggacgttatctgtttaacggaacgaattcagatgtcccgccgatcactgaaaatgccgacggcacatatacgtacaactatgagaattataccggtgcttcggatgttaacatcaacatctcaaacggagcagtgctgaaagtgaattctgatccaaactcagctttcggaggcgtcgcacaaaatggagataatgtatttgaatttctcaactccttagaagcttctttaagcaaaggcacgctgtccgaagcagattcaaatcaaattctgtcagatatcgacggttttactgacaaaatgaatgctgaaaaatccaatatcggcgcacgcacaaaccggttggaactcattcagacaagattggaatcacaagcggcaaccgctgaaaaagtattgtcggataatgaggatgtagaaatggaagatgtaattgttgattatttatctcaacagacggttcatagagcagcgctgtcagtgaatgcgaatatcattcagccgtcactgatcgacttcctgaaataatataactatcgtcttcaatatataaaaaaagcgactcacaacagggagatcgctttttttactaaaatactataaacaggagggatctctgtgcagatgccgagattgattattgacagtgtgcctgctaaaatcggtataacctttcaaaaggaagaaatcgagatggaacagccgcccgctgacctggaaatcgagcagccgccggcagagctgaacatcgaaagcacgccggccaaactgacgattgaccagacgagggcgtgggagaacttgaatctcaaatcatttgaaaagctgaacgctgaagccgctcaaaaaggtgcggaagcctgcagcgagtttatcgcaaaaacagtcagggaagggaaggaaatggcggctatcgaaaagaaaacgggcaatgtgatggcccggcaggcagcagatgtcagtccgcccgatccattcggcgaattcagcgactttctgcctgcgcagtttctcgtcgacattgactgcattccttcaaagcttacgattgatattgaagcccgcaaaccttcaattgaagcagctgtcaataaacctgtatggaattatacgccggggaaagttcagattgatatgatgcaagaccctaaggtgacgatttcggttgatgatggcaacgcagaataaaagatgaaagtggtaaaggattgtgaaggatgataattaaaacaaaatatcacggagaaatcagaatagatgaagggcagattatctcatttgaaaacggcctgccgggatttaatgacgagactcaatttgttgttcttcctttgtcggaagattcaccgtttttggcgctgcagtctgtgaaacaggagcacatcgcctttattgtcgccagtccgtttattttctttaaagggtacgaatttgacattgaccaagcgacgcttgagcttttgcatattgaagatatagaggacgtcgaagtgatggcgattttaacgctggaagagccttttgaaaacacgaccgccaatttaaaagcgccgattatcgtcaataaaaaggaaatgaaggcgaaacaaatcattttacatgatgcttcctatgaaacaaaacatctgataggaggaggatcatgctagttctctcaagaaaagtgaatgagtccattcagatcgggccggatattgaaataaaggtgatcgctatcgaaggagaacaagtgaagctgggaattgaagcgcctcagcacgtagatattcaccggaaagaaatctacttgtcgatcctggaagagaacaacagagccgtatcttttaatactgatttattacttaacttatcctcacaaaaaaagtgaggatttttttattttcaatataaacaatggaagcggccgtccgatatatatattgtagccaatgagaggaaaaattttcttcagaaatgacgctgcgcaaatgcacaaggacgtgcgaaaaacaattcagggaggaaatacaaaatgagaatcaaccacaatatcgcggctcttaacactagccgtcagctgaatgcaggttcaaactctgctgcaaaaaacatggaaaaattatcttcaggtcttcgcatcaaccgcgctggtgatgacgctgcgggtcttgcgatctctgaaaaaatgcgttctcaaatccgcggtttagacatggcgtctaaaaacgctcaagacggaatctctcttatccaaacatctgagggtgcattgaacgaaactcacagcattcttcagcgtatgagcgagcttgctacacaagcagctaacgatacaaacacagattctgaccgttctgagcttcaaaaagagatggaccaattagcgtctgaagtaacaagaatctctactgacactgagttcaacacgaagaaacttcttgacggaactgcgcaaaacctgacgttccaaatcggagctaacgaaggccaaacaatgagcctgtctatcaataaaatggactctgaaagcctgaaagttggtacgacttatacagtatccaatgatcaaaatacattgacatcaactgacggaaaaagcactgctacttgggcggatgaagtaacagatccagatggtaaggttacaaaagcagccggctattatgatactgacggtaaagttattgcatctgaaaaattagctgcagattctaaagtaacaaaaggtatcgacatctcttcttcagctaaagctgcgtcttcagctcttacaacaatcaaaacagctatcgacacagtatctagcgagcgcgctaaacttggtgcggttcaaaaccgtttagagcacacaatcaacaaccttggtacttcttctgagaacctgacttctgctgaatcacgtatccgtgacgtagacatggcttctgagatgatggagtacacgaaaaacaacatccttactcaggcttctcaagctatgcttgcgcaagctaaccaacagcctcagcaagttcttcaattgcttaaaggttaatgacggaaagatcctggttctccagggtcttttttttatttcttcagctaactcctccttcagcaagccaaagaaccctattgacaaaatgaaacattatattttgcagttaaattattgaaaaccttttaatatgaccgatataagaataagatcatacatttatggagctgtgatatgataaacagtcggaaactcactgttgtcatagagccgtctacgactaaacgccgaaaaggagagggtacatatggtcacaagaatcacaggccttaattccggtcttgatgtagattctctggtgaaaaaaatgatggatgccgaaaagcagccgcttaataaattaaaccagcaaaagcagacgcttgaatggaagcgcgatgcttatcgggaaatgaatacccagattgccgacatgtattctactacatttaataatatgctgatgtccacaaactggaataaaaaaacagtaacaagttcggattccagtgtcagcgcggtggccgtcagtgccgaacagaatatttcaacgagcatgtctgtacagcagctggctacgccgacgacttataaatcatcaggggccatcaatttcacttcgggtcaaagccaaacattgaaattcaatgtcacaaatccgggggaaacgaagccgactgaggtaaacgtcacgatcgccgcaaccgatacgattgacgatgtcatttctaaactgaacagctcgggtctcggagtgacggctttaaaagagaaaatctctaacggctcggattatgtggacacgattgcgttcacttccaataaaacgggggaagggtttaccctttcagcaggtgatgacgcgaccaaaagctttctgaaagatcagctcggttttgccgttgatgatgcaacaaatgcactgacggccaatgccgaagggaaaaacgcgaagtttacgttcaacgggcttgaaatgacaaaaacgtcaaataactttacgatcaacggcatcaaatacacgctgaacagcgtgacggacagcaacaaaacggttacgattaacagcacgactgatacggacggcatttttaacaacattaaagatttcgttgataaatacaatacgttaattaaaagcgcaaatgagaaggtgacagaatcaaaataccgtgattataagccgctaaccgatgaacaaagagaagcaatgaccgataagcagattgagcagtgggaggcaaaagccaaaagcggtttattacggagcgacagcacgctgcagaacggtttggcggagatgcggcttgatctgtactcaacggttacgattgacgggaaaaaatatcagcttgccgatttcggaattgagacgtctgatagttatacggatcaaggaaagcttgtcattaaagacgaagcgaaactgaaacagaaaattaccgagaatcctgctctcgtggctaaactgtttaatgcagacagccctgatacagcgaaaaccaaaaacccggaggaacaggggattgcccggagattaaaagacacattaaacaaaatgcagattcaaatttcaaaacaggcgggtacggaaagctcggtatcaaccagctttgccatcggaaaaagcctggatgaaatagaaacaaatatttccaatatgaaaacgaagctggatgacatcgagacgagatattataaaaagttcagcgcactggatacggcattggagaaattgaacagccaatcttcatatctcacgtcaatgttaggatcttcaacttcataaccttgggggttttataaaaatggcaataaataatccttttgctgcttaccagcagacatccgtctttacagccgctccggaagagctgacccttatgctttataacggctgcctgcgattcattaagctggcaaggcaggcgatgaagcaaaacaaccttgaagccaaaaatgaaaatatcgtaaaggcgcaaaacatcattcaagagctcagcatcacgttaaaccgggagattgagatttccgagcagatgtcatccatttatgattacatccgccgccggctgatcgacgcgaacgtgcagaataacggagagtttttagatgaagcggaaaagctcgttactgaatttcgcgacacgtggaagcaggccatgcagagtgaacggaaaaacagccatggcgcgggcggccttgcctgatgaacagcaatgtcttttctttgtataacgaaacgaagaacatgtacgccgcactgaaggacgccccggaaagcgacggtctcatcagcagcgttacggcatttacggagaaaagggaggagatgcttgcgggcataaagccgcctttttccgaagaagaaaaaacgctgcttcagcaggtggccgcgatggaccgtctgattaccggcgaagtgaaacggattcaggatggtatccgaaatgaaataaaaacgcttaagaaaaaacgaatctaccataatacgtatttcaatccgtatcagcaaacgacaagtgacggccgttattacgacaaacgcaaataggtgagtgttttgagaagtttgaacgattaccatttggtgtcagcctattaccagcttctttttacgattgatgaggggctttgctacctgttggacacgcaggatgatttttttaagacggagggcgagcggatttacaacgatttgattcaggctttttttcatctcgattcctctcatgcgcttctgctgtctatcattgagtgccgatgcgtggagacggcgatccgctcatttgacgagatctttcaggatttcagcatgttaaatgattatgatttcccgtccgccccttttcaggagtttttaaaaaccatctttctgccgcattataagctatggatggagcagacgcacgactgtatcaaaccgtatgttcttcactagacctgctgcaagcggcaggtcttttgcctgcgtcctttgcatatacttataatcctgccggaagctgccggataaaaccgacaccattcgtcatcgttcaccgaatttacacattattttaacgtttcagcagggatcagaaggggtaaaagagaaatagttacatatccttagataaagggaggcgttctttgatgaactacaatatcagaggagaaaacattgaggttacacctgcgttaaaggatcatgtggagagaaaaatcggcaagctggaacgatatttcgagcagagcgtcaatgccgatgtgaacgtcaacttaaaattctataacgataaggaatccaaagttgaagtcaccattccgatgactgatctggcgcttcgttctgaagtgcataacgaggatatgtacaatgcaattgatctcgcaacaaacaagctggaacgtcaaatccgaaagcataaaacaaaagtcaaccgaaaattccgcgagcagggtcttccgaaacattatttcgagaacggcagcgctgctgatacgggcgtagcggttcaggacgaaattgaagatgacagcccggaaattgtccgtcaaaagcgttttaatttaaaaccgatggataatgaagaagcgattctccaaatgaatatgctcggacataatttcttcgtattcaccaacgcggagacgaatctcacaaatgtcgtttaccgcagaaatgacggcaaatacggattaattgaaccgactgaataaacccacccagccttccgtgaacgcgcggaaggtttttctctatctttatctgcaaattctttggaaatagcaaaaggtatgttatgataatgagaggtatacatggacagaaaattatcatttattccatgcaaaatctgcatgtgaacatagaggagcgttatagatgcttgggattttaaataaaatgtttgatccgaccaaacgtgcgctgaacaaatacgaaaaaatagcaaatgacattgatgccgtaagaggagattatgaaaatctttctgacgaggcgcttaaaaataaaacggcagaatttaaagagcggcttgaaaaaggagaaacgacggatgaccttcttgtcgaagcgtttgccgtcgttcgtgaagcttcccgccgcgtaaccggcatgttcccgtttaaagtgcagctgatgggggcatcgcccttcatgaggggaacatttccgaaatgaaaacaggggaagggaaaacgctgacgtctacgcttcccgtgtatttaaatgccttgacgggaaaaggcgttcacgtcgtaacggtcaacgaatatctggcaagccgtgatgcccagcaaatgggagaaatctttgcgtttctcgggcttacagtcggcctgaacctgaattcaatgtcaaaagacgaaaaacgcgaagcttacgcagccgatatcacgtattcaacgaacaatgaactcggctttgattatttgcgtgacaacatggtgctctataaagaacaaatggtgcagcgcccgcttcattttgccgttattgatgaagtcgattcaattttagtcgatgaagcgagaacgccattgattatttccggacaagctcagaagtccacaaaactgtacgtgcaggcaaatgcgtttgtccgcacgctcaagaaagatcaggattatacgtatgacgtcaaaacgaaaggcgttcagctgacggaagaaggaatgacgaaggctgaaaaaacgttcggcatcgacaacctgtttgacgtcaaaaacgtggccttgaaccaccatatcaaccaggctttaaaagcccatgcggcgatgcagaaagacgtggattatgttgttgaggacggccaggtcgtcatcgttgattccttcaccggccgtctgatgaaaggacgccgctacagcgaaggtcttcaccaggcgattgaggcgaaagagggcctggagattcaaaatgaaagtatgacattggcgacgattacgttccaaaactatttccgtatgtacgagaagctggccggtatgaccggtaccgcaaaaacggaagaggaagaattccgcaatatttataacatgcaggttgtatccatcccgaccaaccagccggtcatccgtgacgaccgtccggacttgatctaccgctcaatggaagggaaattcaaggcggtggcggaggatgtcgcccagcgctacatgaccggacagccggttcttgtcggtacggttgccgttgaaacgtctgaattgatttctaaacttctgaagaataaagggattccgcaccaggtactgaatgccaaaaaccatgagcgtgaagctcagattattgaagaagcgggacaaaaaggcgctgtcacgattgcgaccaacatggcgggacgcggaaccgacattaaactcggcgaaggcgtaaaagagcttggcggtcttgcggtcgtcggtacggaacgccacgaatcccgccggattgacaatcagctccgcggacgttcaggacgtcagggagacccgggcatcacacaattttatctttcaatggaagatgaattgatgcgccgtttcggagctgaacggacgatggcgatgcttgaccggttcggtatggatgactccacgccgattcagagcaaaatggtgtcacgcgccgtggaatcatctcaaaaacgtgtcgaaggaaacaacttcgattcacgtaaacagcttcttcaatatgacgacgtgctccgtcagcagcgcgaagtcatttacaagcagcgttttgaagtcattgactctgaaaacctgcgcgacattgtggaaggcatgatcaagtcttctctggagcgtgcgattgccgcttatacgccgaaagaggagcttccggaagaatggaatcttgacggcctcgtggagctggtgaattcaacgtatcttgatgaaggcgcgcttgaaaagagcgatatcttcggaaaagaaccggatgaaatgcatgagatgatcatggaccgcatcatgacaaaatataatgaaaaagaagagaatttcggtacagagcagatgcgtgaatttgaaaaagtcatcgtattgcgtgccgttgattcaaaatggatggatcatattgatgcgatggatcagctgcgtcaagggattcaccttcgcgcttatgcgcagacaaatccgctgcgtgaatatcaaatggaaggcttcgcaatgtttgagcacatgattgagtccattgaggacgaagttgcgaaattcgtcatgaaggccgagattgaaagcaatctggaacgcgaagaagttgttcagggccaaacgacggctcatcagccgcaggacggcgatgaggccaaacaagcgaaaaaagcgccggtccgcaaggttgtggatatcggacgcaacgcgccttgccattgcggaagcggaaaaaaatataaaaattgctgcggccggacagaatagtctcgactgtatgaagcgaacatgaccgggtctgcgtcttatggcgccccggatcttttaatgaggtgaatggaatggaattatcagaaatcagggcagagctcgaaaatatggcttctcgtttagcggacttcagggggtctctttgacctcgaatcaaaggaagcccgcattgcagaattagatgaaaagatggcggaaccggaattctggaatgaccagcagaaggcccaaaccgtcatcaacgaagcgaacggtctgaaagaatacgtgaactcctaccatcagctgagcgagtctcacgaagagctgcaaatgacacatgatcttttaaaagaagaacctgaccaggaccttcagcaagagcttgaaaaagagctgaagtcattaacgaaggaattgaatgaatttgagcttcagctgctgctcagtgaaccatatgacaaaaataacgcgattttagaacttcacccgggcgccggcggtacggaatcccaggactggggttccatgctgctcagaatgtatacccgctgggcggaaagacgcggcttcaaagttgaaacgcttgattatctcccgggagatgaagcaggaattaagtcagtcacactgcttattaaaggccacaatgcatacggctatttaaaagcggaaaaaggcgtacaccgcctcgtgcggatttctccatttgattcatcaggccgccgtcacacgtcattcgtgtcatgtgaagtcatgcctgaattcaatgaagaaatcgacattgatattcgtaccgaagatattaaagttgatacgtaccgggcgagcggtgccggcggacagcacgtcaatacgactgattcagccgttcggatcacccacctgccgacaaatgtagtcgtcacatgccagacggaacgctcccaaatcaaaaaccgcgaccgggcgatgaaaatgctcaaagcgaagctgtatcagcgcagaattgaagaacagcaggcggagcttgacgaaatccgcggcgaacagaaagaaatcggctggggcagccaaatccgctcgtacgtcttccatccgtactccatggtgaaagaccaccgcaccaatacggaaatggggaacgtgcaggcggttatggacggagatatcgatatcttcattgacgcctatttacgttctaaactgtcgtaatccgggaacacacctgcctttggcaaggtgtgtttttttatccgttctctttttccatttttcacaacagcgctttagcaaattaatacggtatttggctgttatttacttctaagccgggaagacttaaaatgctatcgagagaaaatcggagaacggaggattttgcatggatgtgaatcacaataagccgctccgtctgatcaaagattacatatatatcatgatcggcgcggcgattacgggggtcgtgtttaacgtatttttgctgccgaaccgtatagcagcggggggagtaagcgggatcagcaccattttagaaacgtttggttttgaaccggcttatgtgcagtggattattaacatccctttgtttatcgccggagtgatcattctcggcgggaagttcggaatgaagacactggtcggttccatcgttctgccgcttgccgtctttttaacaagagatctgcctgccgcgacgacccatgaactgctggcggcgattttcggaggcgtcgggatcggaacgggaatcggcatcgtgtatctcggcaaaggctccacggggggaacggctctggcggcgcagatcattcacaaatacacggggctgtcgctgggaacgtgccttgccatcatggacggattaattgtgctgagcgcgatgctcgttttcggagtggagcagggactgtatgcgatgctcggggtatttatttcaagcaaaacgattgatgtcgtgcaggtcgggttcaaccgctccaaaatggctttaatcattacgcagcatgaagaagccgtcagatcagctgtgtttaaagaaatcgacaggggtgtgacgaagatttccgcagtcggcgggtatacggaacatgaccggccgatcttaatgtgtgtcgtcggtcagaccgaattcacaaaactgaaacaaatcgtcaaacaaattgatgagtcagcctttgtcattgtcgcagacgcaagcgaggtgctcggcgagggtttcaaacgcgcgtaaacgaggttataatagcgaaggggtgcatcttacatatgaaatcaaaatgggcgctgctggcgctggttctgaccatgtccgtcctgctggcggcatgcggcggatccaatgaatcgaaaaaagaaagctctgacagctcaggcggatcaaaagcatctgcgtcagcgggtgaagaactttatcagcaaagctgtatcggctgtcacggtaaagacctagaaggcggcggaggtccgaatttacaggaagtcggcgggaagtatgatgaagctaaaattgaaagcatcattaaaaacggacgcggcaatatgccgagccatcttgtaaatgatgaggaagccgtgaagatcgcaaaatggctgtcacagaaaaaataacagaaaaaccttgcctgttataggggcaaggttttttctcggtctgggaatgaaaagaaactgtaatagtaatatgtctaaatttgacgtataatgaagtgtactgaggaaaaggaactttcagatttttcatctgtttcctgacgaatcggccataaaccgctgtatgtttgcgaactctatggctgcaagacataaataaaagattaggtgatttcatgatagagatgaaagaagtatataaatcctatccgaacggtgtaaaagcgattaacgggctgtcagtcatgattcatcccggggaatttgtatatgtcgtaggaccgagcggagccggtaaatctacttttattaaaatgatttacagagaagaaaaaccgacaaaagggcaaatattgattaatcataaagatctcgcggctgtgaaagaaaaagagattcctttcgtgcggcgtaaaataggtgttgttttccaggatttcaaactccttcctaaattgacggtatttgaaaacgtagcgtttgcgcttgaggttatcggagagcagcagtcagtcattaaaaaacgcgtgctcgaagtgctcgatcttgtgcagctgaagcataaagcgcggcagtttcccgaccagctttccggaggagaacagcagcgtgtttccatcgcaagatccatcgtcaacaatcctgacgtcgtgatagctgacgaaccgacgggcaaccttgatccggtaacatcatgggaagtgatgaagacgctggaagagattaataaccgcggaacgaccgtcgtgatggcgacacacaataaagaaatagtaaacaccatgaagaaacgggtcatcgcgatcgaagacggaattattgtgcgtgatgagtcaagaggggagtatggttcttatgattaaaattctcgggcgccatttgcgtgagagttttaaatctctcggaagaaacacgtggatgacatttgcatccatcagtgccgttaccgttacattgattttggtcggcgtgtttttagtcattatgctgaatttaaacaacatggctaaaaatgctgaaaaagaagtggaaattaaagtattaatcgatctgacgtcaaataagaaaacgcaggatacgctgcagaatgagataaaagacatttcaggaatccaaagcgtagagttttcatctaaagataaagagcttgatcaattggtcaaaagcttcggcgacagcggaaaggccatgaaaatgcaagatcaggaaaacccgctgaacaacgcgtttatcgtcaaaacgacagatccgcatgatacgccgaaagttgcgaaaaaaattgagaagcttgatcatgtgtataaagtgacatacgggaaagaagaagtcagccgtctgtttaagatcgtcggggtgtcacgcaacatcgggattgcgttaatcatcggccttctgttcacggcgatgttcttaatttcgaatacgattaaaatcacgattttcgccagaagaaaagagattgaaatcatgaagcttgtcggcgcgacaaactggtttatccgctggccgttcttcctggaagggctgctgctgggggtattcggttctgtcataccgatcgctctcgtgctgagtacgtaccagtcgatggtcgcttgggtggccccgaaagttcagggatcatttgtttcacttctgccgtacagtccgtttgtgtttcaagtatcacttgtgctcattctgatcggcgcggtgatcggagtatggggaagtctgacttccatccggaaattccttcgtgtataaataaaaaagccagtctgatacagactggctttttttaatggtttcgttactgaatgacgggcagggccggtgatccgggctttaatgtaaagtcataagacgattcgtcacggtacatcgggtccgcataaatggaatccgaatcgtttgccgttccttttcggtacgctgtgaatgaatcatattctctgttcttccaattccagatgccgtcttttccctcttctttgtgatagacgttatgattaacggtattttcttcgtttttcgtaaaatcatttgcgataaaaatccgtgaatcgcttgccgtcatgatgtttttttcgatcgtgttcccttttgtgccgtactgcaggagcagctggccgccgtcaaggtccttcgtgtcatttcggtacatgatgttgtgagcgatcaccgaattgatggtgccgccgcgtttcgtgtcatagcctccgattgaaataccggtgtatgcattgccgtacaccttgttatccgtaatccggatatctcgtgcgtatttccctttatgctcagaggtggcttcaatcccaaggtcattgttgtaaacggtgtttttcttaatgtccacatgttctgcgccgtcaacgtaaataccgcccgctgaatattcatctccgtaagcgggatttccgtaagaagagttatggctcaccgtattgttttcaatgacgccgtttcgcgcatagtcgttttgcttggacgttccttcgtatccgatcacgtcaatcccgatattgttattgtcccggatggtattgccggcaatcttaaatccgtcgacattcccgttcagcacgaccgcttcgcttgcgccgagcgtcagtttttcaaccgtattatttgtaatgctgacatccttcatggcacctgtgccgtaaaatgcgatgccgtgtgcatttccttcatcagccgtggttttaatgttccggatatggttgccgtcaatgttgatatgactgcttgatccggtgacgcagatccccatggccgtcgcatcttctgatgatacggagagattctcaagcgtaacgccgtgaatggtaatgtactgtttattgcggatttgaattaacggagtttcagaatcgctttttggcgcagatttgccgctgattgagacatgctcattctgatagttccgaaatgtaatcggcttttcggccgtgccgctgtgctttacttcaaacgtttcatcgtacgtcccttcccgaatcaatacggttgttccggcctctgccttttcagccgcatgttttaatgtgcggaacggcttttctttcgttccttcatattggtcgctgcctgcgggagaaacatacaaggcgtccgtctgcgctttctcattggcctctgtttttggccagacaaaggcggtaatgcctgcggccagaaccgccgcggataaaatcgataattttattttcatatcgcattctcctgtatatttaatgaattgcatacaaaatattatacgttacccatatatatgaaacaatctcgctttttcatttttttgttgccgttacatgaattctttgcaatttacacatactatctccaggttttcgttaaaggactaagaggaggtaaacgatgaagcagaaaatgatcgcagtgatagcggccctaagcatgatgtgcggcggagcccatattgccggggcggcacagccgaattcatcagacgcagaaagaacccgggcaatggaaaaaatcgaaaaagcatatgagctgatctcgaacgaatacgtggaaaatgtagataaagaaaagcttcttgaaggagcgattcaggggatgctgtctacattaaacgacccttattccgtttatatggacaagcagaccgctaagcagttttccgattctcttgattcttctttcgaagggatcggcgctgaagtcggtatgaaagacaataaaatcattatcgtatcaccgtttaagcaatctccggcagaaaaagcgggcctcaagccgaatgatgaaatcatcagtataaacggcgtgtcaatgaacgggaaagatataaacgaagccgtgctgaaaatcagaggaaaaaaaggatcgaaggtttctattaaaatacagcgtccgggtactgaaaaacagctgtcattccggattaaaagagcggaaatcccgcttgaaaccgtatttgcttcccgcaaagaatcaggcggtcatcatgtcggctacatcggcatatcgacattttccgagcataccgccgaggacttcgccgcggcgctgaaaaagcttgaaaaacaagggattgacggtctcgtccttgatgtaagggggaatcccggcggctaccttcaaagcgtcgaacaaattttaaagcatttcatcacaaaagacatgccgtatatccaaattgcggagcgtaacggcgataaaaaacaatatttctcaaccttaaaacataagaagccgtatcccgtcaatgtcattacggataaaggaagcgcctccgcttcagaaattcttgcgggcgcgttaaaagaagcgggacattatgacgttgtcggcgacacttctttcggtaaaggaacggttcagcaggccgtgcctatgggagacgggagcaacattaaattgacgctttacaaatggctgacaccgaagggcaattggattcacaaaaaaggcattgctccgacaatcgctgtgagccagccggattattttgcggcgggaccgcttcagctgaaacagccgcttcagcctgatatgaacagcgcggatgtcaagcacgcccaaatcctgctgaaaggcctaggcttcgacccgggcagagcggacggctatttcagcaaaacaatgaaaaaagccgttctggcgtttcaagaccggtacaagcttgataaaacagcggtcattgataaaaagacagcggaaaaaatgaatcagctgatgaatgaaaagaaatctgacgaaaaaaatgatttgcagctgcaaatggcgttaaaatcattatttgtaaaataaatgaaaaggaggcgttttttgcgtctcctgtttcttttgtcattcataaaaagtgaaccaaaagacatataattatgacggttttgacaagatattaaaaaaattttcacatttaaacatttataaaggacaaacattacccgatatttatagagaagagagactttatgccgatttaatatgtattcaaaatgaaacttttgaaagttgcctcagtcagttttagttcttacaataaaagaaggttctaatagagaacagttttagtttggcagctgcatttcagtatcgaaagcagaagtgtttgcggcgcttcagcacggcagctgtaatcacccgtgcttatctggataaaaaaatgggggttcacaattgaagagggcaagtattgtgcgtgaaaaaaaatattatgaattagtggaacaactaaaagacagaacaaaagacgtcacattttcatcaacaaaagcactaagtcttcttatgctgttcagcagatacctggtcaattacacaaatgttgaatgcgttcacgaaatcaatgaagagtgtgcgaagcattatttcacttacttaatgaaaaaccataaacgtttaggaatcaatctgacggatattaagcggtccatgcttctgatcagcggcgtgatcgaggtggaggttgaccactatctgaaagatttctctctctcaaatgtaacgttgtggatgacggaagagagatagacgtttgagatattcaagccaatgattatttggtagaatagaattaaaatgtttggcttgaggcggtgaaagcagtgtctgttcaatggggaattgaacttctgaaaagtatcggtctgttttttttgcacccgatgttctggttttttatcatcataagtctcgcatgcggatatttgcggatcaaacgtgaacgccatacgtttcatacaaagatcgcggatatgtatgacgagcttatctttacatacataaaaggacttataccgggtattcttctctccatattattttttggacttggaatttcgattccattcggtcttctcggcataatcgcggctgtgactgctttgctttcgctgacgttccgtatgaattggctgtcctcagcttatattgtcagcgccggcatgttcattgcgtttatccttcagtatacccacacagtgccgtttgcggatcggtttccgcaggcattcggcgtgaattgggcatcggcggccgtgtttatgggccttttgattatcacggagggagcggctgcctgccgttcagcgcatctgaaaacatctccggcgcttgtcgtcagcagcagaggcctgcccatcggccgacaattggcgaatcgcgcatggctgcttccgcttttcttattggtgccgggcagcgggcttgagtcacacctttcttggtggcctgtctttaccgtaccgggcggctctttccatttgatctggattccttatatcgccggcttcggacagcgtgtgcaggggtcacttccggaagtcagcataaggataacggcgaaacgtgtcatgattctcgggttatcgtgaccgcattcggggcagctgccctttggtggactccgcttgccggagctgccgcttgtattgcggtgctcggacgcctgtttttatcattgagacagcggctgaacgataacgcggctccgttttatttctctaagcgggatcagggcttaatggtgctcggcatcattccgaatacacccgcggacgatcttgagctgaagatcggtgagattattacgaaagtaaacggcatccccgtgaaacatgtatcggatttttatgaagcacttcaaaaaaaccgcgcatttgtaaaaatggagatcatcggcctgaacggtgagatccgttttgatcagcgcgcgtcctatgaaggcgaacatcatgaattaggtattttattcgtgcaggatgaacacgagcacgaagaaatgacagcattataatgtgatttttcataattattcggaatagtttcaagaactcctaaactagatttcaaaatcagttagaaagtaaaacagctaagaaaattatattttcttagctgttttattttgaaataataaaaaaataaatgaaggagaggtatggcttattggaaaggttattgctaactccaaaacctttagaagatgaatctttagcaggatatatattaagaataactgattataatggttatgttggatagggggagtacattataaaaaagcttttacttaagagattaccgttgatttcacttggagttatagcttacatactgacaaaatacgcgcagaaccatcaggattgggcggaaaaatacagtaggtctgtatatccgttattgtcaaaaatagtaggatttgtaccttcttgggtcaagttttctgttagtgaatggctcgtcgtgttggttgtgttactttttctattttatatcgtttattatgtgcgcaaggttatcatgagtaaaggtgtacgtaggatggtagtttatcgtggtgctctaggaatagttacgatctgtagcgtgatatatttttgttatactattttgggtggaataaactattacagatattcttttttgtcttataccgaatataaagaagagaactacagcaaggaggaactggtcaaattgagtaagtcgcttgccgttgaaatggaattggcaagggaaaagttagcggacactgatcttttggctcaagtaccagaggtttttgattattatgcacaacacgcagtgttctcgatgcaaatgttatcaaaggaatatcctattttggagcattctttatactcaacaccaaaaccagttgtgatgtcaaagctaatgtcgcatgcagggataaatggcatctttgtcccttttacttatgaatccaatatcaatgttaatgtgcccgttttcttggtgcctgctactatggcacatgaattggcacatcagagtggtttcatgcatgaggatgaggcaaattttatagcatatctggcatgtaagcagcaggatgatccaatgatactttacagtggtttttttctagcatttgtttattctatatctgagctaaagaaagtggatccagatcaggcgtctgatataatgtccagtctgtccaaggcggtgcagcatgatatagaacaaaatgagcagtaccgggataagtatgagggtgttatttcaagtatttcaagaaatgtaaatgatgtatatctgaaggcaaataatcagacagacggtttgaatagctatagtgatatggtgaatttgttgctggcagagcagcgagatagagaagtacaattaaatgtatcttgaatacttataggtttatatagtaatgatagtgggctcaagttgaacataggagtgagtgaaataaataaaataaaagacggcggccgggctttttacggccggattacgatgtcagcgccgaacttgatcggaactctcagccatttacattccccttttctcttgtaaatcaaaagattcttatagagcaaacggcattgcggtgacactttgagagagaaaatgaagaaggaaaactagaaaaggttccggaaagctgatgcttacggaacctttttcgttatgccgaatggctttttttcgtctgaacggtttccccggacttaattccaagcgatacgaacaagccgatcacagaaactccgatcaatatgataaacagaatatgaaacccggagattaaaccgatcagtgctgaagaaataatgcttccgaaataacggaaggtggagaaaatcccggatgcgatgccggacatgcccggttctaccgtcgcaagagaagatacctgcatgctcgtcagccccgcacctgacgcgatgcctcctacaataagcgatgccataagaaacggaacggaatgggaataaaccaaaagcagaaataagagattggctgcggccatcagcccgaaggacagaaaaatcattcttcgcgcgccccatttctgatgcagctgagctccgccccagttgctggcggacatgaaaacagaaaagactgacagcgccatgccgctgtgcgacgtgttcatgctgaagtggccggtcataaagagcggcataatcaataacacggcgtacatcattaaattgcttaacagaaccgacagattggcgctcgtaaaggtcgtgtttttaaacaggtcaaaatcaataatcggatgtttcgtgcgcagttcccgcctgaaaaatagcggaaccaatacgagaatgagcagcgcgtacacccaatagcccaaagagctttcatttttcgtcagaagaataatagatacaatgcttccggcaagcaaaacggacccgatgatatcaagcggagcgtcagacgtttcttctttatatttaggaaacatcattaatgccgtcacgagtgcgatcgcaagaaacggaatgttgacccaaaagatcgaatgccagctgaagctctcaattaatagagagccgataaacggaccgagagctgcgcccagcccggcgccgaggccgaaaaagccgaatactttcggaagccgtttttcagacacgacatggcggatgatggcgatgctgtttggcgtaagcaaagcgccgccggcagcctgaagcgcccggaagaaaatcaataagaaaagacttggcgagagggcgcaccccaatgatgcgatgagaaaaaggccgacgccccataaatacatttttttgtttccgtacatatcaccgagtttgccggcaatgggctgtgtcacggccatcacgattaaatacacggtcactacccatgtgatgctggcaattgattcgctgaatgagcgggaaatggatgaaagggcgactgcgatcatcgtagaattgatgggaacgagtatggctcccagcaaaagcgaaacgatcagcgcccattctttctttgaacccatccttcatcctccttggagccggaaaatgaccggccggtaatgcctttcatgaaaatctcagtgctgtgtttcagcatcgtttcctcagagagagtaatgactcttttccccagctgcagccggtgtataaaataaccgaaaatcatcgtcataaagacgtctgcattagcttcttcgctgccggggcttatcatatttttctttgtcagctccttaaagtaaacgattaaatgctttttcacggattgcggatatacgacaatatcctgcaggacgtcttcgaatagttccggttcgcgcaggcagatgcggaacacttcttttttttgttccaattgctgcagaagggtcgtggcgaaatgaagaagatcctcatacagatcgccttccgccttggtgatcatgctttccggaaccggcgcctgctgttcaatcatggctttcattaatccttgtttgtttttaaaattacggaaaatcgttgcttcgcttacttttgctttttctgcgatttcctttgttgtcgctgcgcggtatcctttttggatgatcagattcatcgcggcgtcaataattctcttgttcgtcgttctcaacatgtttcacctcgcgtaaatactggcaggacaagtatacacccgccctgcccgtcaataaagagggaaacctagcatgaagcgcgtttgacaattgtaatcttgccgtttgtcccgtctaccgtgacgatatctccgtcgttgagcctgtcagtcgcggcacgtgtgccgagaacggccgggagcccgtattctctcgcgatgatcgccgcatgtgacaggatgccgcccgtgtccgtaatgacggcctttgcatcctggaacagactggtccaaagcggtgtcgtcattttgcagacaagcacgtctcctgttgaaaaacgggaaaattcacttgcgtcacgaatgactttcaccggtccgcttgcgattccgcttgacgctgcaagtccgtaaatttgatgttcagtgtttttttcatcttctgtgatggagccggtaatctgttcagccgttttcagctgttccgaagtcggagtcccgagataagcgggggcttcaagcaattgatattgcttgaagagccgttttcgttcagcggctttttcctgcatcggaaccggcgacgccagcgctttctcgacttcatcgctgtataagtaccacatatcctcccgatcatcaattacgccttgtttttgaagcagctcgccgattttcagaaggcaaaggcgcgctttggcgtccagcatcgcatcaatataaaaatggtgatcatctttgatgacggatgaagacaatgtccactgataatagcggtcaaacgtctcccggaagccgtcatcttcaattctatccataaagtcggcgtagagctgttttcgtttttctatcgttttatgaaactcactgtcaaaatcgtatccgtttcggacatagttctgaatgttggccaaagcgaaataagggttttccgcccaagtttcttcaatgagatcatgacttttcacggatctccagccgtattcctgtaaaaattcgccgacttgttcaagaaagcgttttccctcatttgattgcagaagcgtctgatgcagctcatcggcatgagaaaccgtaaagacgcgccgcagctcagggctgtcttttacttgtccggaaagcagccagagctgtctgtcggtctccaatgacttattcatgacgccggccagcatttcatacagaagggaggtgttttctttctcaacctgtccgtacatagattccagtatcatgtttaacgcaacctgcggaaagacaatattgaaatgttctgcgtatccttttaaatagaagtcttgcaggtttcggaacgcatcaatggcagtctccggcgtatggtctgtatgcgccagttcgtccagcttttgataaaaaggcagaaaggtttcctgaataatattgtacatgcggtcagccaagacggggaaaagcgcttctaactgttctgcgggcagcttgtcgtccgtcttatgctgtctggaaaaaacatggccctgatgaagtttgacacgctcaatctcgatgcccatcacagggaaggccttcgtgctctctttgagaccgtattccaaagccggcacaatgagtgaagcgaataacgggctgacgggaccttctatattggactccatattgagccaaaaatctttctgatcccggggcgtcatgataaattcccgttcttcgtctgccgctttctgatcctgcgcgatcgttgtaatcggtctggcctgaagcagatagagcttattttcggcaaatccgaattcgagatccacgggataaccgtacagttcctccgtctttatcgtcagcatggcaagctctttgacgctctcgtcatcaaggcagaagcggtttctcatgtcagcggacgtctctttttccgtcacgccttcgtctttagagacgatatacatttcttttaagccgatttctttttcaatctgaaatgtgtctttattgacgataaatgtgtcgggcgtcacgctgccggagacgattgcttctccgaggccgtagctcgcgctgatcatcagttctccgtcatcatgtgtgacggggttgcggctgaaaatgactcctgaaacctcggaattgatcaaaccttgcacgacaacgcccattaacggttctgcggtgtcattgttcattttctctttataaccgctgacccgcgccgagaagaaggaagcccagcactctttcacttttccgagaaactcttcttcagttttgatatttaaataggtttcgtactgtcccgcgaaagaagcgccttcaagatcttcggacgcggaggaggaacgtacggcgacagaggcgtatgattctctcaattcataaaacgatgcggtcagctcctcccgaagctcttttgaaaacgtgccgttcataatggcgcgctccagctgttcctgatctgcttgaagcccgttgtcttccataaaacgtgtcagggcattcgtctgaatgataaaaccgccgggaacgggcagcccgtttttcgtcagtttaatcaggttcattccttttgctcctgcagagcggctcgattcttccgctttttgaaatcgcactgaatacatgcggtatgaccccctttttttcttcatccaagaaaatgatagtaaacactatcattacattgtaaagagggaggaagaaactgtcaaagatacaaagacctaaaccttctcatcctttcggctgaagaaaggtaattcgattcatctggttaatggttcaatggatttatattcacattttctttgacagatgattgaagactgccgaaaaagggtattgtgatagcaggggaacgattgtccgattcttcattttttactataatcagatgagatgaagaattcccgaggagggtttttgtgattacaaaagccgtttttgcattatgtttcccttttatgctggtcgtcctttttacgcgcgtcacgtttaaccactatgtggcgatcgctctcacagccgcactgcttttcgcatcctatttaaagggttacaccgaaacgtattttatcgttggattggatgtcgtatcgctggtggccggagggctgtacatggccaaaaaagaagcagacaaaaagaaagacaatgcctgacatggtgaatatgaaatagaatgcctgcttttacgccataaaagcaggttttttatacaaaaattgacttggtaaaaataaaccatcgaactttagttcgtatttttagtgattttgcccgtcattgtgttactatatcaataggaagatttcgtaaagaaacggaggcttttttgtgaaagatcgttttgagttagtctcgaaatatcagccccagggagatcagccgcaagcgattgagaagcttgtcaaaggcatacaggaaggcagaaaacaccagactctcctgggtgcgacagggacgggcaaaacctttaccgtgtccaatctgattaaagaagtgaacaaaccgacactggtcattgcccataacaaaacccttgccggacagctgtacagcgagtttaaggagtttttcccgaacaacgctgtcgagtattttgtcagctattacgattactatcagccggaggcgtacgtgcctcaaacggatacttttatagagaaagacgcaagcattaatgatgaaattgataaactgagacattccgcgacatcctctctgtttgaacggagagatgtcattattatcgcgagtgtgtcatgcatatacggcctcggttcgcctgaagaataccgggaaatggtcgtgtcgctcagaccggaaatggagattgagcggaacgagcttctgagaaagcttgtggatatccagtatgcccgcaatgatatcgactttcagcgcgggacgttccgcgtgcgcggagacgttgtggaaatcttcccggcttcccgtgacgaacattgtatcagagtggaatttttcggagacgaaattgagcggatcagagaggtcgacgctttgaccggagaaattctcggcgaccgtgaccatgtcgcgattttcccggcttcccacttcgtcacccgggcggaaaagatggaaaaagcgattctgaatattgaacaggagcttgaggagcgcttgaaagtgatgcgcgaaaacggcaagctccttgaagcgcagcggcttgagcagcggacgaggtatgatcttgaaatgatgcgggaaatgggtttttgctcagggatcgagaactattcaagacatttgacgctccgtcctcctggttctacgccgtatacgctgcttgattattttccggacgattttatgattgtcgttgatgaatcacatgtgacgattccgcaggtgcgcggcatgttcaacggtgaccaggcgagaaaacaggtgcttgtcgatcacgggttccgcctgccgtcagcgcttgacaaccgtccgctccgattcgaggaatttgaaaagcatatgcacaatatcgtgtacgtgtcggcgactccgggaccgtatgaaattgagcatacgccggaaatgatcgagcagatcatcagaccgacgggactcctcgatcccctcattgacgtccgtccgatcgaaggacagattgatgatctgatcggcgagattcaggcgaggattgaacggaatgaacgcgttctcgtgacgactttaacgaaaaaaatgtcagaggatctgaccgattatctcaaagaaatcggcatcaaggtcaattatctgcattccgagattaagacgcttgaacggattgaaatcatccgtgatctccgcctcggaaaacatgatgtgttaatcggcatcaacctgctgagggaagggcttgatattccggaagtgtcacttgtcgccattctcgatgcggataaagaaggcttcctccgttctgaacgttcgctgattcagacgatcggacgggcggccagaaacgcggaaggccgcgtcatcatgtatgccgataaaatcacgaattcgatggaaatcgcgattaatgaaacgaagcgccgccgggaacagcaggagcgctttaacgaaattcacggcattacgccgcaaacgatcaataaggaaatccgcgatgtgatccgcgcgacgcaggccgctgaggataaagaagaatataaaacaaaagccgcgcctaaactggcgaagatgacgaagaaagaacgccagaaagtcgttgagcaaatggagcacgaaatgaaagaagcggccagagcgcttgatttcgagcgggcggcagagcttcgtgatttactgttagagcttaaagcggaaggatgatgaacacatggcaattgaccggatcgaggtgaaaggcgcaagggcgcacaatttaaaaaacattgatgtaacgattccccgggatcagctcgtcgtcgtgacggggctgtccggatcgggaaaatcatcccttgcctttgacaccatttacgcggaaggacagaggcggtatgttgaatcgctttctgcctatgcgcgccaatttttagggcagatggataagccggacgttgatgcgatcgaagggctttctccggcgatcagcattgatcagaaaacgacaagccgcaatccgcggtcaaccgtcggaacggtaacggagatttatgattatctccggctcttatacgcgagagtcgggaagccgcactgcccggagcacggcattgaaattacgtcgcaaacgatcgaacagatggttgaccggattcttgaatatccggagcggacgaagcttcaagtgcttgcgccgatcatctcaggcagaaaaggcgcccatgtcaaagtgcttgaccaaatcagaaagcaaggttacgtaagggtgcggattgacggagaaatggccgagctttccgacgatattgaacttgaaaaaaacaaaaagcattccattgaagtggtcattgaccggattgtcgtcaaggaaggggttgccgcccggctttccgactcactggaaaccgcgctccgcttaggggaaggccgtgtcatgatagatgtcatcggtcaggaagagctgatgttcagcgagcatcacgcctgtccgctgtgcggtttttctatcggggagcttgaaccccggctgttttcgtttaacagcccgttcggcgcctgcccgacttgtgacggtctcggtttgaagctggaagtggaccctgagctcgtcattcccaatcctgaactgtcattaaaggaacacgccatcgcgccgtggacgccgatcagttcacaatattatccgcagctgcttcaggcggtctgccgccattacggcattgatatggagactccggtcaaagacctgccgaagcatcagcttgataaagtgctgtacggcagcggcaatgaacggatctactttaaatacgagaatgatttcggacaagtgcgcgaaaatgaaattgaatttgaaggtgtgctgcgcaatattgagagacggtataaagagacaagctccgattatatccgtgaacagatggagcagtacatgtcacagaagccgtgcccgacgtgcaaaggctaccggctgaagaaagaagcgcttgccgttttggtcaacgggcgccacatcggcaccattaccgagctttccgtcggcgatgcgctggaatttttcaaaaacctgacgctgtctgagaaagatatgcagattgccgatttaattttaagagagattgtggagcgtctcagctttttagataaagtcggtcttgattacctgacgctgagcagggcggcgggaacgctgtcaggcggagaagcccagcgtatcaggcttgcgacgcagatcggctcccgtttgtcaggcgtcctgtacattcttgatgagccgtccatcggccttcaccagcgtgacaatgaccgtctgatcagcgcgctgaaaaacatgagggatctcggcaatacactgattgtcgtggagcatgatgaagatacgatgatggctgccgattacttgatagatatcggcccgggcgccggcattcacggcggccgcgtcatatcggcggggacgcctgaagaagtgatgaatgatgcggattctctgaccggacgttatttgtcaggggctcaattcatcccgatgcctccggagagaagaaagcctgacggccggttcattgaaatcaaaggcgcttcagaaaacaacctgaaaaaagcgaacgccaaattcccgctcggcacttttacggcggtgacaggtgtgtccggttcgggaaaaagcacgcttgtgaatgaaattctgcataaggcgcttgcgcaaaagcttcataaagccaaagcgaaaccgggaagccataaagaaatcaaaggccttgaccatcttgataaggtgatcgacatcgaccaggcgccgatcggccggacaccgagatcaaatccggcaacttacacgggtgtgtttgatgatatccgcgatgtattcgcgcagacaaatgaagcaaaggtgcgcggctataaaaaaggccggttcagttttaatgtaaaaggcgggcgctgtgaggcctgccgcggcgacggcatcatcaaaattgagatgcacttccttcctgacgtgtacgttccgtgtgaagtgtgccacggcaaacgttacaaccgggagacgcttgaggtcacatacaaaggaaaaagcatttccgacgttctggatatgacggtggaagatgctctgtctttctttgaaaatatcccgaaaattaaacgcaagcttcaaacgcttgctgatgtcggacttgggtatgtgacgctcggccagccggcgacgacgctgtcaggcggagaagcgcagcgcgtcaagctagcttccgagctgcataagcgttccaccggccggacgctgtatattctggacgaaccgacaacagggctccacgttgatgatatcgcaaggcttttggttgtgcttcaaagactcgtcgataacggtgataccgttttggtcattgaacacaatctcgatatcattaaaacggcggactacatcgtcgatctgggacctgaaggcggagcgggcggcggcacgatcgtagcctccggaacgcctgaagaagttgtcgaagtgaaagaatcatatacgggccgctatctgaaaccggtaatggaacgcgataaaaaacggatgaaaacattgctggccgaaaaagaaacggcagccacgtaatagatcaataaaaacagcccaaaactcatcggttttgggctgttgttgttacaggctttttttctgttggggaagctgtctgcttaaatgcattaagtcctgcagaatatgggtgctgctgctgtccagcagcacttttatatattggatatcatgggaaatgggaagaggggctgctttgatctgttctaattcagccagcatttcgctgttcattcttttctgttcgcgaattaaatttcgaagactctcttccgttacttgggcgttttcgggatctttctccatttgtatgtcctccttgcatacggtcaggctttgttacatattgtaatcggttcggggaaaagattctatagtgaaatctctgaaaccaaaaattacgtataacgaagcatgtccttagcatgaaaatgaaacccgctcattcgtcatacgtatgtataaggaatggttttttatatcatggcacagggagtgtttttattgaaccgaaatcaagcgattatcgcatcaatctgttatttcagcgtgtttctcgcgccgctcattcttccgattgtggcttactttgtcgtcgatgaaaaagagacgaagcggcatgccatgcgcgctctgatttcccatatcattccgtttgcgggcttgctgattgtgaccgccggtgttgtcggcggattgattacggcccagggggagagtatggtgcccgtttttgttatgataacaggagcagctgtttattttctgatcctcatcggaatggtcatttggaatatcgtgcagggaattaaggtgttacgccaggtgtaagaaaagtcgggggaggagttttgtatgaaacaggagaaagaacggattttaaagcttgtggaagacggcatgctgacggcgcaggaagcactgacgctcattgaaaaactggatcatgaatataaagaaaaagaagatcagatcaccgcattatctgcggaggttcaggaacctgcggaagatttcgaaagcggtgcaaaaggaagccaaaagccgtcgctcggggcgaagctgttcgactggattgattctgccgtcaaaaaagtgaaggaagcggatcttgatctgaatttcggccacgcacacgaagtgcagcatatttttcaatttaaagacagtgaattctcggccattgatatgcagattgcaaacggcagcgtcaatatcgtgccgtgggcggatgaagatatcagagcggagtgccaggcgaaagtgtaccgggcggacagtcaggaggcggcgcgcaccgcatttcttcagcatattgagtgtgaagtgaagggcaataagttttttgtccgcacggaaaagaaaacgatgaaaaccaatgttacgctttatgttcctcagaaagagtacgataagataagagtgaagctgtttaacggaccgatcagaggggaacatttacatgtaaaagaattctcggcgaaaacgacaaacggcgttctgtcattctctcatttgacggctgagaaagcgtcggcggaaacggctaacggacaaatcaagctggccggacatcaatgcggcgcgattgaagcggaaacgatcaacggcttgattgatttgcgcggatcgagtgaatccattgacgttcaaagctttaacggcaatatcatgcttaccgtgacagcgccgcactgccgctccatctacacgaaaacgacgaccggaaacgtggagatcgccctgcctgatgattcggcggtgaaagcggagctcaaaagcaatctcggctctctcagccatgagctgattgatgcggaaattttaaaggaaaagaatgataccattcaaaaagaactgatgctggcatcaaatcaaggccatgatcagcatctctcgattttctcagaatcgttaacaggagccattaagctcaagcatactcagaggtgattggatgaaaagactttaccgttcagaaaaaaaccgtaaaatcgccggcgtcgtcggcggtttggcggagtacatcaatatggatgcgtcgcttttgcgcattatcaccgttgtattagcgcttgtcacgagcggaatcgtgccgattgtatatattatctggtgttttgttgtacctttagaaggagatttgaaataaatgatcaaatgggcagtcagcattttagtaaatgctttattattaatcgttatcgcgggatattttgattccgtccatatcagcagtatcggagcggctgtcatcgccagtgtgattctttctgtgttaaatgtgctgatcaaaccgatcatcgtcatattgacattgcctgtcacggttgtgaccctcggcctctttctgtttgtcatcaacgccattacgttaatgatgaccgcagccttgatgggagacagctttcagattgacgggttcggcaccgccatttgggcatccgtcgtgctgtccgttttccacttgctgatccaaaaaggcatattggagccgcttagaaaaggataaaaaacaagctgtcccgagagggcagcttttttatgtgcggtttacataagcggcagcctcctgacgcaacataatgcatagggaggtaatgagatgaaacttgtgatgacgctcttttttctgattggtttgctttgtgtgagtccttctgcggatgcggcgcgcaaagaatcggcaatccccgtgaatcagcaggaattcggacagccgcctcattacataccgcttctggagaatcctccccaaatcgaagtaaaggcggaaatgaaaagaaacctgttcatacaggctcatgtacggaatgctgactatcaagcgttttcggcgtttcttttttataaacaaagcaatgagctggggtttaagatggtgccgatggagcccgcgccaggcgcaatccggctttttacggcccaggtttcaaaacgggatatctggaatggagaattggaatattacctcgttttcaccaacggcagacagcgggcggaatcggagaaaaagcggctgaagctggacggctatcaagccgatttgaatcatattcccgagctgatgattacggagcttgcggttgatacgaaaaatgaagatggcgctgatgcctatgaatttatcgaggtgtataacacgacggacaggcccattcattttaaagactatcatatccgctaccgctatccgaaggaagggccggaatcagatatgatatggaggccgaaagaggataccgtcattccgtcaggcgggacttacgtgttttggctgagacgcgccgcatcagaactgacgatagatgatttcaaccgctattacgggacacgtctgaaggaaggagaacatctcgccgtcatcgaagggacagacggaatgtccaacggccgcccgcgtacggtcgtgctgtcggcaaataccggcaaggatatcgcctcagcgcaataccggaaacacgctttccgccggctgacttctttgctgtacaaatatccgctgaacggaacgggagaattgctgaagatctccacgagcgagcataagccgtcaccgggctccgtttttcaggcgcagattccgcagcagaaaagggtgatcaaacccgacaaggaaaaaccggtcatcgaagaccttacagacagaaagcccgtccggcccgctgaaagcattgaattaaaggctgacataaaagacaaaaaccttgtcaaaacagccgcgttttattaccggaccaatgagaaaaaaccattcaaacgaattctggccgaaaaagaccgcaacgacagcttataccatcacattctttattccccggaactgctcggccaggatcagcttgagtattatatcgcagccagtgatggagaaaatgaagcaaaaacgcccgtcaagatgattgacattgaacagacgagcaaatcacacggactcagaatgaatgttgaaccggaagatacgatatccggcacctatctgctcaaagcgacttccgacgtcagcgccgataagatcaagctgtggattgacggcaagcggcaggagacccggccggcgctggaaaaagaggtctatttcgccttcgatgcccggaaaacgaatctttattttcaaaacaccgtcatgatggaaaacgaggtgctgcacatttttgacgatccgtctcaccgctacagaacgcactcggttctgcttccggaacgtctgctgctaaaagggggcaaaacacagaaagtatccatccgttcgggctcaaaggtttctccgtatgacacgggagagaatcgggatgattttgtcgtgaaacatgcccgtctggtgctttcggacggaacggtgatcaaagacgggaagacggacccgtccgagcagctgtttatcggtgacggcaagcgggcgaatcagcagaagaccttctcattcagcctgccggatcatttgtttacgtcacggctgctgccgtggaacacggcgaagctttcggaaggctatcaccatatttttgtcagtgacggtgaggagcagctgagccaatctgtgagggtggacaattcggggccgaagattgtcccgggtattaaagaaggcgcggcgctgaaaggtaatgttgagctgaatgcggacatccgtgataaatggagcaaagtggaagaggtgaaagcgtttttggacggagaaagcattacgctcccgcatcacacgtcatcagccgatctcaagcccggaaagcacacccttactatcattgcggcagaccttgccggaaatgaaacaacgtccgtccgcaccttccatatcaaacgggaggagccgaaccagccggagcttgccggtcaaaaaatcggcgcccgcaaagcaaagctgtccgtccgggtaaaagacccgacgaaggatgacatgaatgtatcattttatcgcggcttccgttataccgcgcggaatccgggcagcgtgaaagtgtataaacacgcctcattaacggaaccgccgaagggcataaaagaaaatgaaatgccgtttaccctgccggaaatgaaccgtatctcggcaaatgacggaaaaaccgtttcggcggaaagtgtggagcgttttccttatcaccggttcgaagtctccgttgacccgtctatcgacgaaacggatctggccgaggcggtctggaaaggaagctctctgcccggccgaaaggtaaccatgtatatttggaattaccggacaagccgctggcaggaggcggacagcgtccttgccaaagataaaaagccgtttacattaaaagccgccgtttccgcagcggatgtggtgaagaactcaaaaatgaatgtcatcgtgcaggatcaaataccggcgaaaggcaattacacgtttgtctggatgtcggatacacagtattacgcacaagggcacccgcacatttttgacaaaatgacggagtggatcaaagaaaataaggaaaagcacaatattaaatatgtctttcataccggtgatattgtcgatgattcaatggtgatgaaacagtggaaaaacgccgatcactccatgcggacgcttgacaaggcggggattccgtacggagtgcttgccggcaatcacgacgtcggccataaagacggcacataccgaaccttcggggatttcttcgggagccgccggtttgaacagaacatgcattacggcggatcatacaaaaataaccgcgggcattatgatctgctgtcggcaagcgggaacgattttattatgatttatatgggctggggcattacggaacaagagattgactggatcaatcaagtgctgaagaggtatccggaccgaaccgccatcttatgctttcatgagtacttgcttgtgagcggaaatcgaagcccgatcggggagacgatctatcgaaaagtcgtcaagccgaatcgcaatgtggcgatggtattaagcggccattaccataacgccatgaaaaaaaccgatgcgcttgacgatgacggagacggaaaaccggaccgcctcgtccaccaaattctgaccgactaccaggacggtccggaagggggcagggctttatgcgcataatgcaatttgatcaggccgccaatcaggttcacatgttctcctactcgccgtacacggatgacatcaattactatgacaccgatctgttcgctgataaagacgaattctcagcagaaatggatttacagccgaagaggaaaagggtagcgactgattattttgaatgcaacgtttatacgaacgaactgctcggtcataaaaaacacgtaaaaagcggaaaaaccgcaaattgggtctgggacggcctgcagcctgattccgtttattactggtacaccgtcgtgaaggacccgtacaacggcaaaacaatatcaccgctgtggatgttcaaaacgggaaatacgccgtatcacccggctccggatcagtttgatttcaggcatgcctcaaacccatagcaaaaacatacacctgccgatcggtcagaagaaaatctgacggtcagcaggtttttttctgtaacatgcatggcggtaagtgtttttgacttttttatgtcccttttctatactaaaatcgattggttttcgtaatatgcaggaggaaacataatgaacagtaaaaccgggacaaaagaaagaattattcaaacctctgcatatctttttcagattcagggataccatgcgactggtttgaatcaaattataaaagagagcggagcacccagagggtcagtgtatcatcactttccaaacggaaaagaagaactcgccattgcggcgatcaaatatacgggaagatgcgttgaaaagcagatacagaatagtatgtctcaatccgcggaccctgtagaagcgattcagcactttattcatgtaacggctgaacagtttaatgatccgcagaatattgagggcgtgccggttggattgctggcgggtgagaccgctctgatcaatgaaacgttaagatgcacatgtgttgaggtgttcaagaagtggacggatgtgtttgcggcaaaatttcttgagcatgggtttgaacaagaggaagcggagaagcttgggatgacaatcaactcgatgattgaaggcgcaatcatgttttcattggctcataaaaacaaagaaccgctgctgctgatttcaaagcaggttccgtatattgtccaaaacagaggatagcattttattactcttttctttataaaaatagataccggaaccccagcctcttcgttttgacagagtcatagagaacattcaccggcttgatttgaaaatggcagatcaaaaaaacatctccaacccgtaacggttggagatgtttcatttcaccctgtccatataatgcacgaatgtgtagcggtcgcctctgtaggcggatttgacgtgctcaaaggcagtgccgtcctgcagataagtggtccgcttgatatagaggacgggggcgccgggctggataccgagcagctcagcttcttcctcggaagcggttcccggttcaagctcttgttttgcccgtgagatcggcatctgattgtacgcttcaatatgctcatacatggatgattgaaaatgggaggcatccaattttcccgccttgtcaaacgggatatacgatgcctcaatcgccatcgggatatcatttgccagccggacgcggatgattttatgaagcgttgccggatagccgcaccccaggatagaagataattcttccgtcgcctgaatcagctggtattcggcaagtctactccccggcttcatgccccggcttctcatatcttcggtgaagcttgtcagcccttgaagcggctgttccatcttcagtttgctgacgaacgttccccggcctttctgtctgtataaaaatccttcattcaccaaattggaaagcgcctggcgcaccgtcatgcggctgatgccgaattgttcggcgtattcccgctccgacggaagcagcgcatccgctttcagctcgccgtttttgatttgtgtttttaattgttccataatctgaaagtaaatcggaatcggagattgtttatcaatctgcataggtcaaatcctttcaatcgccgcccgcagccttttcatcaatcaagaccgtcacatccggatgcgcgtgcagggcggaggcggggaatgcttcgctgacgcgcccgtccagaagctgcttcaccgcttgggccttgctttttccggatgccatgatcagaatccgtttgccggacaaaatcgtcccgatccccattgtcagggctttttcagggacttgatcaattgacggaaagtaccgcgcattcgcctgtcttgtctcttcattcagctcaacaacatgggttcgggattcaaatggcgtcccgggttcattaaagccgatatggccgttgtgtccgatgcctaaaagctgtatatccgctccgccgagtgtttgaatcaatcggtcatagcgcccgcattcggcatcaagatcgtctgcccgtccgtcagggagaaagtggcggtcctttcggctgtcgatatgtgcaaaaaaatgtgtattcatataataatgatagctgtttttgtcctcgggagaaagcccggcgtattcatcaaggttgatcgtcgtgacattccggaacgacaagccttctgagcggtgcatccgcacaagttctttgtatacgccttcaggagtgcctcccgtcgcaaggccgagaacggcatccggcttttgtttcactgtttcagcgataatcgctgcggctttttcacttaattcttcataatgtctgcatgtgataacgttcatgtccaatcagcctcccttgagatatatgcggtgtttccgcggcaaatcgtggccagcacgccgcactgtccgtccgtcagaacaacgtcggcgtcttttccttcggcgatgcttcctttacggtcgaatatgccgaggcggcgggccgcatttgccgatgtcatatttgctatatccggccatgagcagtttgtaaacctgcgcatgagcgccgcgccttcattcatttttaaaatggaaccggccagcgtcccgtcagagagaagcgccgtgtccccgcgaacggtgactttttgtccgccgaattcgtattctccgtccttaagcccttttgcccgcatggagtctgtaatcatgatcaggttttggcttcctttcgccaaataggcaagcttaacagccagaggatgagaatgaatgccgtcagtgatcagctccgccgtgatgcggccgcaggcgagagccgtaccgatgcccccggctcacggtgatgaaaggagctcatggcgttaaagaggtgcgtcatatgcaccgccccggcatccgccgctttttgtaaaagctcggctcctgcgtctgtgtgtcccattgaggggatgatgttttggttttttaaataacggatcaggctgaaatcaggatcttcttccggcgcaagcgtcacgattttgatcagccctcccgagagccgctcccatttctgaaagagcccggcatcagcaggagtaatccattgtttcggctgtgctcccgcctttttcggagagacaaacggtccttctaaatgaatgccgatcaactcagcgcctttttgggtctccggtgaggaatacgcccattttttggcgttgatgagcgctttttcaatgttttcgtgctgctgtgtgatcgttgtcgctaaaaaagcggttgttccttcttcgggcagccgggcggacagtgtatcaagagccgcaacatcggcatccatcgtatccgcgccgtatccgccgtgaatatggatatcaatcattccgggaagcgcatacgagccctcgggcgccttccattccttctcatacgtttcttgcggccttgtttttcccgcgtaagaaatgatgccgtcctttataccgagaaaaccgtttcggatgatttctttttctgttacgatgtccgcaccgctgattaacaagctttcagccactttaaaacacgcctttctggttagttgttagttttattttactccttttcagactagttatctagaccagttatgccggaattgtataaatctgttttggttcagacggtaaagtgataaaatataactgttcaaagctcggaacatcccagaacaggaggaacatatcttggcaaaggttcggaccaaagacgtaatggaacagttccatttagaattgatcagcggagaagaagggattaaccgcccgattacgatgagtgatttatcacggcccggtattgaaatcgccggttattttacatattacccgagagaacgggtgcagcttttaggaaaaacggagctgtcatttttcgatcagcttcccgaggaagataagaaacagcggatgaaatcgctgtgcaccgatgtgacgccggctatcatactttccagagatatgccgatcccgccggagcttgtagaagcttccgagcaaaacggcgtgcctgtgctcagatcccctctgaaaacaaccaggctgtcaagcaggctgacgaattttcttgaaagccgtctcgcgccgacaacggccattcacggcgtgcttgtggatatatacggcgtcggcgtgctcattacgggaaaaagcggcgtcggtaaaagtgaaacggcgctggagcttgtcaaacgaggccatcgtcttgtcgcggatgactgcgttgaaatccggcaggaggatcaggatacccttgtcgggaacgcgcctgatctgattgagcatctgctcgaaatcagggggctcggcattataaatgtcatgacgctgttcggggcgggcgccgtcagaagcaataaaagaattacaatcgtcatggaccttgagctttgggagcaaggaaagcaatacgaccgtctcggacttgaagaagaaaaaatgaaaatcattgatacggaaattacaaaactgaccattcccgtccgcccggggcggaatctcgccgttattatcgaagttgcggcgatgaacttcagattgaagcggatgggcttaaatgctgccgaacaattcacgaataagctggcggatgtcattgaggacggcgaacaagacgaataggagttggcaataatatgaatgaagctggaacaccgatcaatccgattgccttgcagctcgggcctttatccgtgcactggtacggcatcattatcggcgcgggcgcgttattagggctttggatggccatgagggagagtgaaaagcgggggctgaaaaaggacatttttattgatcttgttcttttcgccatcccgatcgcaatcatttgcgcaagggcatattatgtgcttttcgagtggagctattactcggaacaccccggggaaatcattaaaacttggaaaggcggcattgcgattcacggcggattaatcggcgcgatcgcaacgggaattgtcttttcaaaagtaagaggcatctcattctggaagctggcggatattgccgcgccgagtattctgctcggccaggccatcggacgctgggggaactttatcaaccaggaggctcacggtggagcggtcagccggtcatttttggaaagtctgcatcttccggatttcatcattaatcagatgtacatagacggacaatattatcacccgacgtttttgtatgaatcgctgtggagttttgcgggcgtcgtgattctgcttctgctccgccgcgtgaacctgcgcaggggcaatctgtttttgacgtatgtgatctggtattcaatcggcagatactttattgagggaatgcggacggacagcctgatgcttacgagccagcttcggatcgcgcaggtcatttccattgtgctgattatacttgcgattattttaatgattttcagacgcatgaaggggtatgccgataagcggtatgctgacacggactgacgactgaaatcggaaaggacataagatgactgataaacatgtaaccgccattttattcgatctcgacggcacgctgattgacacgaatgaactgattatcgcttcttaccttcatacgcttgatcattattgcccggggcagtttaaaagggaagatgtacttccgtttatcggcccgcctctgtacgaaacgttttcaggcattaatgccgaaaagtgcgatgacatgatcagcatgtacagagcattcaaccataaaaagcacgatgagctcgtcacggagtacgaaacggtttatgaaacgctggatgaattgaaaaaagcgggctatcagcttggtattgtcactactaagctgagggatacagtcaatatgggattgaagctgacaggcatcggggcgtttttcgatactgtcgtcacgcttgatgatgtaaagcacccgaagcctgaccccgagcctgtgcggcttgcgctcagccggcttgggtgcgatccgtcggaagccatcatggtcggtgacaattatcacgacgtcatggcgggaaaaaacgccggcacgaaaacagccggcgtcgcgtggacgattaaaggcgcacagacgctttccgcctatgaacccgattatatgctcgagaaaatgagtgatttattgcacatcaccggagtgaagtaatccgtgagaaaaacagaccgccatccggttgcaggtgcaaattcattgtggcatgtttatcagacggttcccttcctgaaggtgatgaaaaatttcatcatcattcagattgcaaggtatacgccgtttttaagcgtgaaaaactggctgtaccgaacctttttgaaaatgaatgtcggaaaacagacgtcattcgcgctgatggtgatgccggatatcatgtttcccgaaaaaatcactgtcggaaaaaacagcattatcggctacaatacgacgattttggctcatgaatatttaatacgtgagtaccggaccggttttgtcacaatcggtgacgaggtgatgatcggggcaaacacaaccattctgcccggcgtcaccatcgggagcggagccgttgtatcagccggcacgctggtgcacaaagatgtccccgccggggcgtttgtcggaggaaatccgatgcaggtgatttatacgcacgaagaaatgaaaaaacgaatggaaaaccccgcagattaacgtcagcggggttttttatgacttgatcacaatggcctggctgcccatctgcttccaggctttttcaaagtcagaccggtctgtttttctgtttttatagccgtaaggatcattaacgtatacataatcgtgatcataaccggttacggctacgctatgcatgctgaacgtaatgtcgatctttccgttcggtgtatcccaagtctgcatatgatcaaccggcttaaaggatgtggtggtaatcacccagaccggccgccctttttcaagctggcggtacactgaagaaatgtcttttcccgtaagatcgtatactttgtttcccgcatattctttggcaagtttatcaatcggctcatgataaacgcctaaacccgggccgttttccatatctccggcaaatccttcattcggatctcccttcagcccgctgctgtatgtgagcggaactttattgattttatccgccaatgtattttttgacacatgatatccggcattgttcaaaatcatggcaaggctggtcacctcacagccattgtacagtctgggagaatccatctgtctgtacagaacgacattcagcggtgacgcgctcccttttaacggtgttttctcatcaggctcgtcggactgctgattgaaaaaatttaaatgaatatcgtttgtatagatgttatatcccagatagacaaggatggctgtcagaatcagcacacataatgttccaagcgtcttcattatcaattattctcccttgtttctgatgaagctgttctatgtattatagcacttctgctcaatatgattcgatcgttccgatatgtttacaggtttgttcattctttagccatgtttatggaaaagaataggcggacattgggcgttgcaatccattcttttatctgctaacatattatcatattagcgaactaaaggattcggaattttccttcagacaaagcggaggtgtaaaaggcaaatgtttatgtttgagaaaccgcatggcatgagagatacgctgcccggtttatacgaagccaagaaaaaagtccgttccacactgacggatttaattgataaatggggttatcagtttatggagacgccgacccttgaattctatgaaacagtaggcgtccagtcagccattgaagaacagcagctgtttaagcttctcgatcaggacggaaaaacgcttgtgcttcggcccgacatgaccggaccgattgccagggtggcggcatctaagctgcacaaacacaatcatccgctcagagcggggtacgcggcaagcgtctatcgcgctcaggagcgggaaggcggacgtccggccgaattcgaacaggtcggcgcggagctgatcggcgacggatcaacaagcgcggacgccgaggtgattgcgctggcggccggcgctttgaaaaacgcgggattgcaccggtttaaaatcgcgatcggccatgccggactcgctgatgagctgtttgtcgaggttttgggcaatgccgagcgggcggatgttctgcggcgctttctctttgaaaagaattacgtgggatacagggaacatgtcaaatcgcttccgctttcttcaatagacaaaagccggctgctcgcacttttggaattgcgaggcgggaaagagatttgcgccaaagcggaggagatcatcggaatctccggacaaagcttaattcaggagctggaagacctgtgggacattcttgaggattacggatgtgccgagcatattcgccttgatctgaatatggtaagccatatgagttattacacgggaattttattcgaagtgtacgcggcaaatgtcggtttcgtcatcggaagcggcggacgctataacaatctcctcggccatttcggcagtcccgctcccgccacgggcttcgggctccgtatcgacaggctgattgaagcgctcggcattcaggaagaaacaagtgaagcggacgccgtgattttcagcaaggagcagcgggcccaggctattttattcgcggaggaagaaagggcgagaggcagaaaagtcgtcctgcaggatctggcgggcattgaaaatatcgatcatatgacaaaatcattcgcaaacgtcacatactttatcggtgccagaaaggaagagaggaatgggtaaggtactcacaatggcaatgccaaaaggacggatattcgaagaagcggccgggttgctgaggcaggccggatacaggctgcccgaggagtttgaagaatcgagaaaactgatcattgacgttccagaagaaaatctccgctttattctggcaaagccgatggatgttacgacttatgtcgagcatggcgtcgctgatgccggtattgccggaaaggatgtcatgcttgaggaagagcgtgacgtgtatgaggtgctcgatctgaaaatcagcaaatgccatctcgccgttgcggggcttcccggggcggattggaacggagtcgcaccgaggattgcgacgaaatatccgaatgttgcgtcgagttatttcagagagcagggcgagcaggtggaaatcattaagctgaacggctccattgagctggcgcctttaatcgggcttgctgacagaatcgtagatatcgtatcaaccgggcggacattaaaggaaaacggtctcgttgaatcagaacatatttgtgacatcacatcgcgttttatcgtcaatccggtcagctaccgcatgaaggatgatgtaatcgacgaaatggcggccaggctggcacgggttgtggaaggagaaacggcaaaatgaacataaccgcagtaaaaagaagcgagcggttttcactgaagcgttccatcgacagcggaaccgaagagcagcggaaaaccgtcagggggattattgaagacgtcagacaaaacggtgacaaagccgttttggcctatacaaaaacatttgacggcatcagcctgaaccaaatggccgtgagcgcagaggaaatcaccgaggcataccgtctgcttgatgatcagctgctggaagtgatcagacaggcgattgccaatattaaagaatatcacgagcgccagctgcaatcctcttggttttaccatcgcaaagacggctcgatgctcggacagaaaataacggcgctcgattccgcgggcgtatacgtgccgggcgggacggccgcttatccgtcttccgttttaatgaatgtcatccccgcgctcgctgcgggagtggaacggatcgttctcgtcagtcctccgggaaaagacggccgcctttcaccgggcgttctggcggcggcgtctgagctcggcataaaggaaatttacaaagcgggaggcgcacaggcgattgccgcgctcgcttacggaacggaaacgatacagcctgttgataagatcacgggccccggaaatatatttgtagcactcgcgaagcgcgaagtcttcggcgttgtggatatcgacatgattgccgggccaagtgaaatcgtggtcctggcagacgatacggcggtgcccaaagaagtcgccgctgacctgctttcacaggccgaacacgatatgctcagttcaagcgtgcttgtcaccgattcacagaagcttgccgaagcggtatcagatgaggtgaataaacagcttcagaccctgccgcgcaaagaaatagccgaagcgtcgatcagggatcacggccgcatttatattacggaatcgatggaagatgcggtggacacggtgaatgagctggcgcccgagcatttagaaatcatgacgcattcgccggaggctttgcttggaagcatcagacacgcgggggcgattttcttaggacgatacagcgctgaaccggtcggcgattattttgccggaccgaatcacgttttgccgacaaacggaacggcgcggttttcaagcccgctgaatgtaacagattttcaaaagaaatcgagcatcatctcttacagccggaaggcatttgaaacgcacgcggacagcatttccgccttcgcgagactggaagggctggaagcgcacgcaagatcgattgaagcgagaaacggaggaatgaccgatgagaaaagcggaacgcgccagaacaacaaatgagacggatataaggctggctttcgaaatagacggagaaggaaaagccgacatcagcacggatgtgccgtttatgactcatatgcttgatttgttcacaaagcacgggcaattcaatttaacggttgacgcaaaaggcgatacggagatagatgatcaccatacgactgaagatatcggcatctgtttagggcaggcttttttggaggcgctcggtgataaaaaagggatcaaacggtacggatcagcgcttgtgcccatggacgaagcgctcgcccaagtcgccgtagacctgagcaaccggccgcaccttgagatgcgcgctgcatttccgcaagcgaaagtcggaacgtttgataccgagctggtacatgaattcctatggaaactggcgctcgaagcgagaatgaatctgcacgtcatcgttcattacggcacgaatacccatcatatgatagaagccgtatttaaggcgcttggcagagcgcttgatgaagcgtcatccattgatccgcgcgtcaagggtgtgccgtctacgaaaggaatgctgtaaatgatcggtgtaattgattacggtatgggcaatttattcagcgtgtcgaaagcgctggaacgcgtcggcgtcccgtatgtcgtatcagaccggccggaagagcttgaaaaagcggatgcttttattcttccaggtgtcggatcattcagtgacgccatggacaatttacgcagcacgaagcttgatcaattcatacaccgtatggttgacgagggtaagctgctcctcggcatctgcctcggcatgcagctcattttcgaagagagcgccgaaaacggctctgcaaaaggacttggtttattagccggaaaagctgtgagactcaaagacagagatgccgaaggaaacaagctgaaggtgccgcatatgggctggaaccggctgacgtttcaccaaacgtctcctttgctttcggaagcggaagaaggcttcgtttactttgtccattcctattatatagacgggatggaagacggcgatcttctggcaagcgctgagtacggcgttcgtgttccggctgtcgtcgggaaacgcaatgttttcggtgcacagtttcatccggaaaaaagcggtacagccggaatggcgatcttaacacaatttacaaaaatggcagcggaacagaaggtgaagaaatgaacgcttttacattatatccggcaatcgatatgagaaacggcaaatgcgtccgcctcatccaaggcgattacggcaaggaaacgatatacggtgactctcctttagacatggcggcgcaatttgcacaagaaggcgccgaatggattcatctcgtggatcttgacggcgcgaaagcaggcaggaaagtaaacgacaggcatgttcttgacattgcgcggcagcttgatgtcaaagtcgagatcggcggcggtatccgttctgaagcggatgtgtacggttatttatcacaaggcgttgatcgcgtcattctcggcagctcggccgtttccgatccggcatttgtgaagagcatgctgaaacaatacggcggcaaaatcgcgatcggccttgatgcaagaaacggatatgtctcgacggaaggctggctggaaacatcctcggtaatggcggccgatctgggccgtgaattggcggccgaaggagcggaaaccttcattttcacggatattgcaactgacggcatgctgtcaggaccgaacatcgaaagtaccgttcagctcgcaaaagcaacgggaaaagacgtcatcgcttcaggcggagtcagctcagtcgccgacctcaaagcactggcccgcttcaaagacgccggcgtatcgggagcgattatcggaaaagcgctgtatacaaaacaattttcattggctgaagcgctcagaagggtgaaggacgcatgatcacgaaacgaatcattccgtgtctcgatgtgaaagaaggacgcgtcgtcaagggcattcaatttctcgggctgaaagatgcgggcgatcctgtcgagctggccgaagcctacgacagggagggcgctgacgaacttgtttttctcgacatttccgcctctcacgaaggccgcaagacgatgacagacgtcgtagaacaagttgcggcaaaactggcgattccgtttacggtcggcggcggaatcaatcaattaagcgatatgaaacgaatgcttcgcgccggcgctgacaaggtatccgttaatacagcggccgttctccgtcccgagctgattacggaaggagctgagtttttcggctcgcaatgcatcgtagcggcgattgacgcaaagtatgacgaagattcggaatgctataaagtgtacacacacggcggcagacagaaaaccgagcgggaagtcacggcctgggcaaaagaagccgtcagccggggagcgggtgaaatcctgctgacaagcatggacgcagacggtgaaaaaacaggctttaatcatacgctcacacagcttgtctcacgtgccgtcccggtgcccgtcattgcgtcagggggagccggcagcgcgcgccatatgcttgaagccttcacagtcggtgaagcggacgccgcgcttgcagcttctattttccattacaaagagacatctataaaagaagtgaaagattatatgaagaaacacggggtgaatgtgagatgaaacaggcagatgaactgcggtttgacgaggccggactgatacccgccatcatacaggatgcggcaagcaaagaagtgctgacactggcttatatgaaccgagaatcctatgaaaaaacgatagaaacgaaagaaacctggttttacagccgttcacgcggggagctgtggcataaaggagcgacatcggggaatacccaaaaggtgaaagccatccgttatgattgcgatcaagatgccctcgtcgtgcttgcggagccctcaggacccgcatgccataagggaagctacagctgtttttccacggaaaaagcagacgcgcaggatcgtttcggcatcttaaatgaactggaaagcgtgatcgccaaacggcaggcggagatgcctgacggagcctacacaacgtacctgtttcgggaaggcgtcgataaaatcctcaaaaaagtcggtgaggaagccgcagaggttattatcgccgcaaaaaaccgcgaccatgaagaattaaaatgggaagcggcggatttgctgtatcatttgctcgttcttctgcgtgagcagtcgcttcctttggatgacgtgcttgacgtccttgcgaaacgccattctgcatctgagtaaaacaaacctcgcggagagacccgtgaggtttttattctgtcaaacttaaacattcaataaaatattccttatttccgcaaccgtaggcagatgaatttgataatattgactaatagagtttattttggtttttatcaaaaatatacgttttgttcatattccgttcatgcacatccgttatagtataaacagtgatataggaggaaaacatatgccgaataaacaaccaaaaccaaaagggaaattcagctcattcttttcattagtcaaaaaaacaaaaccatcatacggtatgctggccttcgcgctgtctctcagtattgtgacaacgctcgtcagcctgctgattccgctgttgacaaagcagctcgttgacggcttttccgtgtcgtcgctgtcaggcgtgcaaatcggaatcatcgcagccgtgttcatcgtacaggccgcattaagcgcctacgccacctacgccctgaactacagcggccagaaaatcatctcgggactgcgtgatttgttgtggcagaaattaattaaactgcccgtctcttattttgacaaaaacgccacgggagaaacgatcagccgtgtcaccaatgacacaatggtggtaaaagagctgatcacaaacaatatcagcggatttattaccggaatcatttccgttatcgggtcactgacgatcttatttttcatgaactggaagctcacattgctcgtgctgatcgtcgtgccgctggctgcggtgattttagtgccgatcggccggaaaatgtttaaaatttctcgggaaacacaggatgaaacggcgagattcaccggattattaaaccacatcctcccggaaatcaggcttgtaaaagcgtcaaacgctgaagaagcggaatacggacgcggaaaagcaggcatcatggcgctctttaaactcgggctgcgtgaagcgaaggtgcagtcgctcgtaggcccgcttattacacttgtattaatggcggcgctggtcgctgtcatcgggtacggcgggatgcaggtgtcatccggtgaattgacagccggcgcactcgttgcctttatcctgtatttgtttcagatcattatgccgatgggccagatcacttcatttttcacacagcttcaaaaatccgtcggcgcaacggaacggatgattcatattcttgcagaaaaagaagaagatatccaaatcggaaaagccattgaaaacgcggatcagccgattaagctcgaacaagtctcattcggctacaaaacagatcaaaccatcttaaaagacattacggctacgattgaggccggcaaagtcaccgcgatcgtcggaccgagcggcggcgggaaaacaacgttatttaagctgcttgaacgattctacaacccgactgcgggcagcatcctgctcggaaatgaaccgattgatgcgtattcccttgagtcatggcgggagcatatcggctacgtgtcgcaagaaagcccgttaatgtcaggcaccatccgcgacaatatctgctacggattaaaacgcgaggtgactgatgaggaactgaggcaagcggctgacatggcctacgccctgcaatttattgaagacttaccgaagaaatttgaaacagaggtcggtgagcggggaattatgctgtcaggcggacagcgccagcgcatcgccattgccagagcgctccttcgcaacccgagcattctgatgcttgatgaagcgacatcaagtctggacagccaatctgaaaaatgggtgcagcaggcgctggaagttctaatggaaggccgcaccacgatcgtgatcgcccatcgtttatccacggttgtggatgcagatcagcttctctttgtcgaacagggtgaaatcaccggacggggcacacaccatgaattaatggcatcccattcgctgtaccgcgattttgcggagcagcagctgaagctgaatgccgacttagaaaacaaagctgtgtaaagcaagactttatgaatagaaagcagctgaaaaagctgctttttattttgcagccggagttctcttcatagaaagcgggggttaaattatgaaaaaacgcacaaagattttttattggcacgcggccttactgctcgtattcatgactgccgggtgtacggacggtaacgatgaagagccgagccattcttcaagtccggccggagaaagcagcggcatcaacaaggctgaaacagcatcagcggcagaaaaaaaagaaccagtaaacaaagattcacatcacatctctgcggacaaaagcctgtcggcagattattctcctctgcaaattgaatatgcccgcatctggctgcagcttggggaaaatcagcagatagatgaattgaacgttcgccgcattccggccggagcactcgtcaaccctgacgatcatacgagcgcccgctatcccgaagatgttacgcagttagcaggctcccggttagtcgatgggtcagtcacttacagcagcaatggtgacggcaccattcagatatacaatgttcctttgcgctgggagtctcgtgaagatactgatcaaggcgtaatgaaagaagtgacggaggaaatgatccgccatacaaaaaaagtgtctgtcgatacaggagacaatgaaaaaataagatggttaatagacatcatgtcgattcattaaaagaagacaggcaaaaaagcagaaggagggatttttatggctgtcatattggttgcggatgacgaccgccatatccgtgagcttgtccgactcatgatggagcagagcggctttgacgtcgcagaagcggaagacggggaagcggcggtgcggctgatcgaatcagcacctattgatctcatcatactggatgtgatgatgccgaaaatggacgggtttgaagtcagtgaagccgtccgcagctttacggacattccgattttgatgctgacggcaaaaggcgaaacgctggacaaagtgcaaggttttacttccggagcggatgattatctcgtcaaaccgtttgagccgcttgaactggaagcaagggtcaaagcattgctgaaacggtaccggatcaccgctgaaaaactgctgaccatcggaaatgtcacattagataagcaatcccgcaccgtaacgcgcggcggcggagcgggattgacgctgccccggcgtgaatttgagcttttatttaagctcgccggttatccgaataagacgttttcaagagaacaattaatagaagatatttggggctttgattatgaaggtgacgagcggacggttgatgtgcatgttaaaaggctgagggaacggtttccggaaaaggactatccgtttgctatccatacggtgcgggggctcgggtatcggtttgtggtgacagaatgaaacggatcttcagaacggctggaaaaatcatcatccttctcaccgtcaccgcattcttatggctggcggctcatctgatcgttcagggattcggtctcatatggccgattttgcttgtgccgtacgccgagcagattctgacgctctggcttgttttcggcctgctgtttataacgatgtttatcttttcaaagtcagcacgtgaaagacatcatgcgatctgggattcactgaccgccacgatcaagcaaatgtcgagcggcaacttcacagcggccgcctccaggaaaatggagaagattgaacgggaccaccccgtgacgaaattggctgatgaactgtcgacactcgccgcggaactgagtgaaatggaaaagctgaaacaagaatttatttcgaacgtttcccatgaaatccaaaccccgcttacttcattaaagggctacgcgcacctcctgaaaaaaccggatttatcatatgaggagcgggggcgctatttacacatcatcgagacagaaacagaacgattatcaaaaatcagtgaaaatctgctgaagctcactgcgcttgaacgccaaaccgaaccgatacaaaaaaaaccgttccgcattgacaaacagctgcggcgcaccatattgacctgtgagcctgaatggtccgccaaacagattgagtttctcattgatttacaggagtcgtatgtgtacggagatgaagcgctgctcagccaagtatggatgaatctgattcacaatgccgtgaaatttaccggtgaaggcggccgcatttccgttaaaattgttgatctgccgggagcggcggctgtcgaaatcgccgacgacggaatcggaatggagcctgaacaggcggagcgggtatttgaacggttttataaagcggataaggcgagaaacgcagggggaagcgggctcggcctgtccatcgcccaaaaaatcgcagagctgcacggcggttcgatagaggttgagagcaagcgcggcgaaggaacccttttccgcgtcattcttccagccgagcctcgtgaaaaaaacagctaaaatctggtcgaaccagccagtaaaaaacgaagccgatcctgtcttttgaactattgaggcgaaaccgttttatggtatactactgacggtaatacgtataaaacggaggatatttgtgggaaaacacacttctgaacagaaaaagcacgcgcaaattgtccagctgcttcaggatggacaatatttttttcataaaggcttaaaagcatataaagagcggaatttaaaacgggccagcaaactgattcagcgggccgtccatctcgagccgaatgattccgaaatgctgtcacggctggccgtcatttattctgaaatgggccactaccagcagtcaaatgagctgttcgactttattttggtgaacctgaaagaagaaatgcccgagtgtcattattttaaagcgaataatttcgcgcatttggggctctttcaggaagcatacaaagaagcggaggcttattcagatgccgatccggacggggaattcagcgaagagattgaaaatctgatggagcttttggatttcggcgaagcgggtgaaaacgaatcgctctatgaccaggatgagctgctgatcaggcaggaccgggcaaaaacgcttcttgagagcggccagcttcatgaagcggttgtcatgcttgaagagattacggccgattaccccgagctttggtctgcatacaacaacctggcgctcgcttacttttactcaggcaatgttacaaaagcgaaacagacggtattcgaagtgcttgagaaaaatgaaggcaatctccatgccctgtgcaacctccttgtattctgctattacgagagggaagatgaaaaagtcggagaattgagcggaaaactcgccaacgtgtatccgattttattcgaacagcgctataagctgggggcgacgcttgcgcttgtcggcagacatgatctcggttataaatggctccgttctctttacaaaagcgggttcgaaggcgacgaaacgttttattactggcttgccgcctcagcctacgggacaggccgcacagaatttgcggaaaccatttggaaaaaggccgaagccgaatttcccgaatcagaccggcccgcgccttgggcggagcggcaggaaccgctgcctgcttcacttgaacagcggcttgccgcctattatatcagcagcgctgaaggagagcggaaccagcttgaaaaagttctgacggcaaaacgcgccgtttcaccgtttgaacaagatttcgtcagactgctgctttccggtgaaaaaggcgcttcaggcgtctccggtgacgcgctgttcacgtatcggacggtcaagcttctggagaaagcggaagccgacagtttaaaaactgacgtcatgagctgctgggtttttcacgtcattcagcacatccgcgccgccgctgccgtacagaatgagcgggcatgggccgcagccatcgcatacgtatggaaagaagcaaacggcgaaaaaacgacgaaaaaagaaacggccgccgtttacggtataaccccggcaaccctttcgaaatacatcagacaaatagatgatatattagaataaaaccgattctttctatataaagagtcggttcttttttttattataaaggggcaaaacagaactttaccgccgaaaaaagaggtattcatacgtatttttttgctttttgaatcgaaatcaggccgtaatcaccgtttattttgcaaaatatgagatttgcaatcacattgaaatataactgtaataaaaattgtcgaaacatgatggtataatgagtctcgtacataagagattagtttattttacatgtgctgtataatctataccaattaaccagattcaaagaatcgtacataaaaatcatcagcctcacgggcatgtgagggagcgtaactttgatgttcataatagaattccaaatgagaacaggtttaaagtaaaagggaggaaagaaaaagtgaaaaagagtttattaacacttggtttggcttccgtcatcgggacaagcagttttttgatcccgtttacaaaaactgcatcggcggaaacattagacagcaaaaaagcgaaaattgaaagcaagcaatctgaggtggcttcaagccttgaagcaaaagaaagagaattgtccaagcttcaggacaagcaggctaagattgaaaaagaactgaaagacattaacgctaaagcgttggatacaagcaataaaatcgaagataaaaaagctgaaaacgaaaaaacgaaaaagcagatcgctgatttgaaaaaagaaatcaaagaaacagaagcgcgtattgaaaaacgcaatgaaatcctgaaaaaacgcgttcgttctttacaggaaaacggcggttctcaaggatacatagatgtacttttaggggcgacaagcttcggagacttcatttcccgtgcgactgcagtatcttctatcgttgatgcggataaagacctgatcaaacagcaggagcaggataaagcgaaactcgaagacgcagaggctgaacttaacgtgaagctgaaaaaagttcaagatgatcttgcgaaactcgagtctatgcaaaaagacctgaacaaacagcttgatcagaaagacaagcttttcgacgaagcgaaaaacggtcagaaaaaagcggcttccgctatctctgatctgaaaaaagaagcgtcacagcttgcaaaccaaaaagctgacactgaaaaagagcagaagcgcattaaagctgagcaggctgcagcggctgccctgatcaaaaaacaggaagaagcgcaaaaagcttctgaagaccaaaaccaaaaagatgacagccagccggcaccggcggttaaaactgtgaaaaaagcggctgtttcaacatcatctgattcatctgacagctcaagcaaaccgaagagcacttcaggcggatcatctcataacagcggcggttcagatgattctgacggcggatctgttatttcaaattcaggcggtattgaaggcgcgatcagcgtaggatcaagccttgtgggtcaatctccgtataaattcggcggcggacgcactcaatccgatattgacaaccgtatctttgactgctcttcattcgtacgctgggcttatgctaacgcaggcgttaatctcggacctgcaagcggcacaaacacagatacattaatcggaagaggtaaagcagtaagcgcgtctgacatgaaacgcggagacttagtattcttcaacacgtataaaacaaacggccacgtcggcatctacttaggtaacggaacgttcctgaacgataatacatcacacggtgtatccattgattctatgagcaacccttactggaagaaagcattcaacggcaatgtaagacgtgtcgtgcaataatgaataagacaagggccttctatcccggaaggctctttctttatttgtatacccgctcaggagctccctaatcacggtttctcagaaaaatgagcaaaaaaatagcgaattgccctcagatttaataggatatgggtaaggaatacgattgatggggattcttagtcatatagggtgcgccccatttcgaaaaggagtgaatcatggtgtcagaagaaaaaatttatgatgtgatcattatcggcgcgggtccggcggggatgaccgctgctgtttacacatcacgagcgaacttatccacattaatgatcgaaagaggaattccgggcggccagatggccaacacggaggatgttgaaaactatccgggttttgaaagcattctcggccctgaactttctaataaaatgtttgaacatgcgaaaaaattcggtgcggaatatgcgtacggcgatattaaagaaatcgtggacggtaaagaatataaaacggtcaaagccggttcaaaagaatataaagcgcgcgccatcgtcatttctgccggagcggaatacaaaaagatcggcgttcccggcgaaaaagaactgggcggccgcggcgtatcgtactgcgcggtttgtgacggcgcgttctttaaaaataaagagcttgtcgttgtcggcggcggagactccgccgttgaagaaggcgtctatctgacacgcttcgcttcaaaagtcaccatcgttcacagacgtgacaaattgcgtgcgcaaagcattcttcaggcgcgtgcctttgacaatgagaaaattgacttcaaatggaacaaaaccgtaaaagaaatccatgaggaaaacggaaaagtcggcagacttactcttgtggataccgtgacgggagaagaggaagaattcaaagctgacggcgtctttatttatatcggtatgcttccgctttctaaaccgttcgaaaacttgggcatcacaaatgaagaaggctacattgaaacaaatgcccaaatggagacaaaagtcccaggcattttcgccgcgggagacatccgtgaaaaaacgctccgccagatcgtaacggcgacaggcgacggaagtattgcggctcaaagcgttcagcattatgtggaagagcttgaggaaacgctcaaaaccgttaaataatcactgtaatgttcagtttttgaatcgttactgtgttttaattacgctgtaacacgggtgaaatactgatgttttaagatgaatgtagtaattgaccccctttttaatgaatacactttggcacggattccagtatccgtgccctttttttgcgattttttgttttctgtcaaataaaagaaaaggatgtcggtgtctctgcattgtgagagacatgccgaaacggtataatgaagagacgatgatttgttgagaaggttaggtgacgtacttgtgcaaagagtgacaaattgtgtgctgcagacagatgatcaggttctccttctccaaaagccgagacggggctggtgggtcgcgcccggcgggaagatggaaagcggcgaatccgtcagagattccgtcatcagagagtacagagaagagacgggcatttatatactaaatccgcagttaaaaggcgtgtttacctttattattaaggaacaggaacaaatcgtgtcagagtggatgatgtttactttcgtcgccgactcctacacggggcggaatgtcgctgaatcagaggaaggcgttctgaagtggcatgacgtaaaagatatccacagccttccgatggcccccggagacgggcatatccttgattttatgatcaagggccaagggcttttgcacggcacctttacgtatacgccggacttcgagctgctcagctatcgtttagatccgcagcttatcaaataaaagaaagaccgcaggggggagaaagatgagtatgaatgaaaaccatgatattcagctcgtcatcattacgggaatgtctggagcggggaaaaccgtcgccattcaaagctttgaggatctcggctatttttgcgtcgacaatctgccgccttccttgctgccgaaatttttggagctgatgaaagaatcaagttcaaaaatgagcaaggtcgcgcttgtcatggatctgcggggacgtgaattttttgacaggctgattgaggcgctggatgaaatggcggaaaatccgtggattacaccgcgcattctctttttagacgctaaggattccatccttgtgacgagatacaaagaaacgaggcgttctcacccgctggccgctaccgggcttcctcttgaaggaatcgcgctggaacgccagctgcttgaagaattgaaagggcgctctcagctgatctatgacacatcggatatgaaaccgcgtgatctgcgtgaaaaaatcgtggcgcatttcgccacgaaccaaggtgaaacatttacagtgaacgtgatgtcattcggtttcaaatacgggcttccgatagatgccgacctcgtgtttgatgtaaggtttctgccgaatccattctacattgaaagcatgaggccgcttacggggaaagatgaggaagtgtcatcctatgtgatgaagtggaacgaaacacaaaagtttattgaaaagcttgttgatctgctcggctttatgcttccgtcttataagcgggaaggtaaaagccagcttgtcatcgcgatcggctgtacgggcggccagcaccgctccgtcacgctcgctgagtatttggctgactattttaaaaaagatttctatactcatgtcactcaccgggacattgaaaagagaagccggaaatgaataagaagccgaaaatcgcaatcttcggcggcggaacgggtctgtccgtgctgcttcgggggttaaagcataagcccgttgatattacggcgattgtgacagttgctgatgacggcggaagttcaggccgtctgcgggatgaacttcaaattccgccgccgggtgacatccgtaacgtactggctgctttgtcagatgttgagccgctcgttgaaaatctgtttcagcaccgtttcaacaaaggaagcgacttaaccggacattcgctcggcaatttgattttggcagcgatgacaaatataaccggtgatttctttcacgctgtcaccgaaatgagcaaggtgctgaatgtccgcggcagagtgctgccggctgccaacaccagtgtcgttcttcacgctgaaatggaggacgggcaggtcgtctccggagaatcgacaatcccttcttacggccagcgaattaaacgggtgtttcttacgcctgaaaaaattgatccgctgccggaaacgattgacgtcatccgtcaggccgatttaatcattatcggtccgggaagcctgtacacaagcattcttccgaatctgctcgtgccgaaaatcggagaggaagtcgtcaaggccgcggccaaaaaagtatatatatgcaacgtcatgacacagcccggcgagacgcttcaatacagcgcggccgaccatgtcaaggcgctgaacgatcatatggagcagccgtttatcgacacgatcttaatcaacaatgaggagatccctgacgaaatcaaaagcaaatatgcgaaagagctggcccggcccgtcgacttcaatgttgaaaagctgaaatccatggggcttgaggtcatcagggatcagattatcacgtataaaaatggcgtaatccgtcacgatacacataaagtggcttctcttcttgtcgatttattaagggactagaggccttttgaaatgaggtggctaatatgtcatttgcatcggaaacaaaaaaagaactgacgaatctggaagtgaaggactgctgcgccaaggcggagctgtccgcgctgattcggatgaacggttccctgtcattttcaaaccgccatctcgtgcttgacgttcaaaccgaaaatgcggcgattgcccgccgcatttatacattgctgaagaaacaatatgatgtatcggtcgaactgttagtcagaaaaaaaatgcggctgaaaaaaaataatgtttatattgtgcgcttttctgaaaatgcaaagctgattttagaggaattgaaaatcctcggggagaactttgtatttgaacggaatatttctgaggaactggtggcgaaacggtgctgcaaacgttcttatatgagaggggcgtttttggcgggaggatctgtgaataatcccgaaacatcgtcgtaccacttggaaatcttctcgctttataaggaacataacgattcattatgcgccctgctgaatgattttcatctgaacagcaaaacgcttgaacggaaaaaaggctatattacgtatttaaaagaggcggaaaaaatcactgaatttctgaatgtcatcggcgctcacaattcactgctgcgctttgaagatgtgcggattgtcagagatatgagaaactcagtgaaccgcctcgtcaattgtgaaacagcaaacttaaacaaaaccatcggggcttctctcagacaggtggaaaatattaaatacattgatgaacggatcggtcttgaagcgctgccggaaaagcttcgcgaaattgcgcagctgcggattgattatcaggaggtcacgctgaaagaactgggggaaatggttgcaagcgggaaaatcagcaaatccggcatcaatcacaggctgagaaagctcgatgaaatcgcagaacagctgcgtacaggacaaagcatcactttgaaataaccgtacagaaaaggggagatcttatggttcaggggaaagtggaagtgcgtttaaagacgggattgcaggcgcgccccgctgcattgtttgtacaggaggcaaatcgttttgcatcagatgtgtttcttgagaaaaacggcaagaaagtgaatgccaaaagcattatgggattaatgagtctggcggtcagtacggggacggaagtcactctgatcgctgaaggcgacgatgaaaaggaagcgctggaaaagttgtccgcttatgtgcaggaagaagtgtaaacactttgtaagggggacggaacgatgaatgagtttctgaaagattgttatcaaacgataggctgggaaaaggattccctcgatttcagcaacctgccggagtttttaaaggcgctcgcgtatcggtttccgtttgaaaaccgcgccgttttgtccaaaaaagaatatgacgtcacgaaagaaggactgtggcggcacatggtgaaggaacctcacggcggtctttgttatgacttgaacggactgctttatttcatcctgaaagatgccggatttgatgtcaaattgatccgcggaacggtctggaaaaacggctgggcgctgcccggcacacatgcggccgtacttctttccgccgggggaaatgagtacatcgctgatgcaggcttcggcctcaatctcgccatgcagcctgtgccgatgtcgggagacgagacggtatcagcggccggagcgttccgcgtgaggatagaagagacggaattcgggacatacgtgcttgaaatgaacaaaggggacggctggcagacaggctacgcattttcgcttgaagaaatcgatgaaaaggacctcaagtctatgaaacaaacaatctttgaacatgaacgttctcctttcaacaaacgcctgcttgcttctaagcggacaccggaagggcacatggttctgtctgaacgcaatataacaataaaaaaacacgatggcacggcggaaaacagcagaatagaccgctcagagtttgaagaaaaatttactgctcattttatatgaagcttgcagattctctgcaaaaaaacggcctccgcagggaagccgttttttgtatgtgtttatctcatttttgtaaaggtttgatagtggtctgtcgtcttataaatcagccagtcgcttgagtaaagaatccggtctgaatttctgaagcctgatgtatagttaatatccgcttcacgccacgtccgtccgctttttacagggagtttgccttccctgtttgagaagatgtccccgccgatgcttttccccggggcgacgtccgccagattcccctttgatgccacccagccgagggcctgtgcttctgattttgtaatgtagttatcaggaagcttgtgataggtctgaagataatccgcaaccccgtcaaacgtgttgataacctgtgcttcagtgtgcgccttgtgagaagatgtatccgtcttggcagccgttgaaaacagcatccccgccgcggagaacagcaccagcaaacaaacggaaatccacgataatcgttttttcaaagcaatacctcccatttttatcatgtgaagctgattccttttcattgtatcagcatcaagagaaaggaatagaaagaattttaaaatagtacttttgatctagcgaaaaataaaccccggctgaaacggccgggatttttcatctcattgaaattccttcgtgaggtttttcggtgtttttccgtatacggcgtcaatcatgttctgtgcggcttgcttgaacatattcaagcggatttttgcggttgctgacccgatatgcggaagcaatgtgacgttttccagctgcaggagcggattatcttcggcgatcggctctttttcaaacacatctaaaccggcgccttttatccagccctcttgcaatgcgcggatgagcgctttctcatcaactgtctttccccgggaaatattgacgaaacatgccgtatctttcatcaatttaaattccctctctcccatcatatgatatgtttcgtcagtaagcggggtaattaaaagcacaaagtctgatgttttcagcagtgtatctaagtcggtatatgtaaccccgagttccttctcggcatccggttttctgctgcggttataatacagcacgtccatatcgaagccgaattttgcccgtttggcagcttgttcaccgattctgcccatgccgataattcctaatgtctgatggtggacatccataccgaaaagagattcctcctcaacggttccccatttgccggcgcggacgaatcgatccaattcggcaacccgtctggcggaagacagaattaatgaaaaagccagatcagcgacagtgtcatctaaggtgtacggtgtatgcgtgccgacaaccccgcgccttttcatttctttaatattaaaattatcatagccgactgaattattgctgacgaccttcagcttcggcgcgtgatccagcaaatcactgtcaatcgccgttccggatgtcagcagcccttcagcatctttcattttttcgtacagtttctcttttggaatggtatcttctttccagatgtcatagcggcaatgctcgtctatcatttgttcgacttcgggcggtatcggtttcgcgatgaatacatagggtttcaacgggcttctcctcctttgtctttcttctctattttattatataagagaagcggtaacgtgagaaataatcaaacgcattacgataaatttctggttcttttgaacttaaaatgaaagaaaaaggaatgtacatgcttgatttctccaaacaataacagaatccgcctatatttctgaaggcaaaatgagcggaaccgctgttttcaaaagctttataggttggtgtaaagataaattttattatttttgaaagatataaatgaatataatctgaatttacagtcaaattatcgtgtctttttttgaaagcgcttttgaggcctttttctgtgctataattccttactgtaagctgggtaagaaggcttgcaatacaatcggatgggagatgaatagaaaaatggtttctttatcaagcattttggagcacaaccagcagtttgtccaagaaaggaaatatgaaccttaccaaacgacaaaattcccgaaaaaaaagcttgtcatcgtatcctgtatggatacaaggctgacggagcttctgccgcaggcgatgggactcagaaacggcgatgccaaaatcataaaaaacgcgggagccattgtttctcacccatttggaagtgtcatgcggagcattttggttgccgtttatgaactgcaggcagaggaagtctgcatcataggtcaccgcgagtgcggaatgtcgggattaaatgcggcttccatattaaataaagcaaaagagcgcggggtggaggacaaatgtctcagccttctgcagcatgcgggagtcgatttggaaacatggctgaccggttttcacagcgtcgaagaaagcgtggcccacagcgtgaatatggtcaggcatcatccgctcttgcctgaagaggtgccggtgcacgggctggtgatcgatccgggaacggggacgctggatgtagtcgttgacggttatgaaacagtcaaaggaggatgcagctgacgatgcaatttaccggcagatatcagggatacaatttgcagaaatttcagaaagacctaatcgcgggaattgtggtcggaattgtagcgattccactggggatggcctttgccatcgcctcgggggtcggtccggaatacgggctttacaccgttattgtggccggaattctgatttcgctgttgggcggctctaaatatcagatcggcgggcctacaggggcgtttgttcccattttatttgccattgtgatgcagtatggttttgagaatttacttgtagccggttttatggcaggcgtcatgctcgtcctgtttggcgtatttaagctcggaaagattatgaaattcgtgccgaagccggtgatcgtcggatttacggccgggatcgcggtgctgattttctcggagcagattgcccattttctcggtctgcgcgatatccaaaagcatgaaagctttatcctcaacattgcggaaataggcaagaagatcggaacctttaatttgtacagcatcctcatcgcgggaattgctttggccattttgctgttatcagccaggctgatgccgaagattcccggcgcgcttgtggccctgcttgtctctacagccgctgcggtcgtgttttttcctgacaaaatggcgacaatcggttctgcttacggagaaattccgcggcagcttccggctttccagcttccggatttctcaattgataacatggtgatgatgtttccctcggctctgatcattgcgcttctcggcggacttgaatccatattatcggcgatggtcgcggacaatatgaaaggatcacggcatgacagcaatagggagcttgtcgggcagggcatcgccaatatggcagcgccgcttttcggcggcataccggcaacgggagcgattgcgcggaccgcaacaaatattaaaaacggcgcagtttctccgatttccggtgttgtccacggagtcaccgtcctcctcgtcctgctcgtcttcgccccgcttgccgttcacgtaccgctggcaagcatggcgccggtattgatggttgtggcttggaacatgagtgagcggagggaagtcgccaatatgatgcggctgaaaaacactgattcattcgtactggcggcaacctttttgctgacggttctgtttgatttaattatcggcgtttctgccggtcttgtgctcgcttttgttttctttatcagaaaaatgagcgaatcaacaagcattaaaacaccgcatgccgcggtcaaatcggttaaaaatgattcgtccgtcagcacatattccattgaagggccgctgtttttcggttcaattgattcactggaatcatcgctgctggagaggcttcaggaaaagccgaagacgcttattctgctgatgaataatgtgcattacatggatacctccgcagaagcggtgctggggaatgtgatgaaccggatcaaacggcataacgggagattgatgatcgtcggattgcaatcacagccgagagagctgatccggaagacggggctgtttcataaaatcgggaaacagcatttctttgagcatcaggacgagataacgggataaattcagatacggcctgtccatgaaaaagcggacgggccgtgtttttattcggtttcaaagcgcttgatcagtttttcctgatgggctttcatcgcatcttctaacgtgattccgtacttatcggcaaggatagccagatttccgaggacgtcacccatttcttcaatcagctcctgcctgcgttcagcctgggttgcgtccttttcatccggccggtctctgccgatttcatatgctcttaccgcccgggcgagctcacccgcttcttccattaaaaagccgattctgataaatggcccgtacgccgtccatcctcgtttttcgtaaaaatctttcgtccattgttctgcttcagccatctgcatgtgaaacactccttatgtcctgtatgattcttattgatattatcatatagagatgggacaatatatagtgtattttgatttattgatgtacatatatagatgcggagatgaaaaaatgaaaaccatttgtgtatttgcggggtcaaacccgggggtaaatgaagagtacaaacgcaaagcggccgaactgggtgaatatatggcggagcagggaatcggccttgtttacggcggttcacgggtcggtctgatgggaaccgtcgctgatgcgttaatggcaggcggcggaaaagctgtcggcgtcatgccgagcgggcttttcagcggagagattgttcatcagaatctgacggagctgattgaagtcagcggcatgcatgagcggaaagcgaaaatgagtgaacttgccgacgggtacattgccatgcccggcggtttcggaacatatgaagagttatttgaagtgctgtgctgggcgcaaatcggcattcatcaaaaaccgatcggactgtacaatgtgaacgggtattttgagccgatgatgaagatggtcaagtacagcatccaggaaggattttcgaatgagtctcatttaaagctgatacatagttcctcccggccggatgagctgattgagcagatgaatcggtatacatacccgattttagataagaaatggcgtgaattgtaaggcagcggtctgaaatatgtttcggcggctgcatctaattcattctgacggaaagttcttttctccttctcatgcgtaccacgcctttcttcgtaataagagatatgtctgagaataagaggcgaatgagactgctgttggggttgaaagaagaacatccatttcctcagaggagatggatgttttgcggtttccagactgtatgcgtttacaacttttgttgcacgaaagtttcttccgatatgaaatcatcctgctgcatcttttgtttttttgaaccgattccaaatataccgactgtcagtgcacaaagaaaccagcagcctgtaaagaataagaaaacacttaaaaatccgtagcctgaatacaggaaactgacgacaaagggaccggctacatttgcaaggcgtcctacgccgtaagtgaggccatttccagatgccctggcttcaaccggatataattccggcgtataagcatatgcgatcgaactgaaagtacgctcaaacatatgcatgagaaatccgcatacgataatgaccatcggcaaaggattgatgccgtaaaagaatccaagcgccataataattaacgataaaacagaaatggcccactttcgatccacacggtcagagatttgcgccgcaatgagagcgcccagcggggcaccgatcgttcccagagtgacgtatacgatagactcatccattgatacgccttctttcaccagaagggtgggaacccacgtgccaaagccttgaattgcaatggtggaagctgcccacatcgtcattaaaacaaaagttcttcctgctaaaggcttttgaaacagcgtccgatatggaacggattttacagcggtttgtctgctttgcagagccggagctggttcaggcagttcacccttttcattttctgcttttgcctccagttcaagcagaatgcggtgtgcttgttcgctttttcctttcgtgtccagccatttcggtgattcttccagttttctggcgatcagcggaaaaaaaataccgaccgcgccgaatagaaagacaaaccgccagccgtaagaggcggacggcacgaccaatttagccacccagccggccgcaggaattccgcatatgccgattgtaatacagattgcctggtatttgcctttagttgcggatgggaaaaattcgctgatatacgtactcgccacaatcgttgtggcgccgatacctaaactcgtaaaaaatctaaaaacaccgagtatttctgggttccaagccagagaagagaggagggagaaggaagagaaaaaggtgacaaccagaattaaaccttttttccttccgaaacggtctgaaaaccatcctccggcagaggcgccgataaacattccgaaataggagacagatgtaataaaagcgatagtatgagtggatatgttccattcctttaaaagtgaaggcgccgcatatgaaaacgtatttaaatcgataaaatcaaaaaagtaagcgaatgaaaggataacgagcactgcttgatgggcccttgaaaaaggcagtctgtttaatcgattagacgcatttacattgatcatctcgtattcctccgtttatctttgacttgtctgaagacggtattaaccaatgtgattgagcgtattcatgctgtaactttgtttagtaaacacatagccttcagagatttttcttgctgtgcgtactactttaatcgttgttccatccggatcaacatctgcctcggtttttaaaataccgcttggatgccccaatcggatcgttctcccggagaatgaaaattcagataatattgtatcttgcaatagcatgccggcagtcgtacataccgcccctgtaatggctaaagcttgatgcggtttttgcatggacatcatacgaatgacaagatccatctcttctgcgtgtctctttatcccttttgtatcgatataatccgctggagatgagattaatgtcagttttggtacggccggtgattttgcagcagcctcatgtctcggagcgaatctgcatttctcggctgcaatcgatcggatcatttcgagcttttccaatatatccggggtatattcatccggaagttctaagccggtaagccccgtgtcctctgcttttacaaagacaagcggattggcgtaatcaataatcgataccgagatatttccatacggggtatcgagaacatcaataggctgaccggtgggaaacagcttaccggtcaccgctccttcagcctggtgaaatgaaagataaataggagaagctgtacctggaacccccggaatagagcagtccccctggtaatgaaatgttccatttctgacttcgacttctgctgcgatcactttttgagtgtttgtatttaaaattctgacttttgtaaccggctcttcagcttgaacgagccctttctcaatagcataagggcctacggcagaagagatatttccgcaattgcctttgaagtcggtaaatttgtcagtcagactgacctgagcaaacgtatactcaacatctgcatcctttctggcggatttcttaataatggctgccttgcttgtgagagaatggccgccgccgagaccgtcaatttgtctctcgtcagggctccccataatgtctaaaagaaaatcgctccataggtttgtatcgtctggcatgtctttttgaagaataaaaacgcctttgctggtgccgcctctcataacggttacaggaactttttccatgctgtctcatccttacatcattttgtgtggataaaaaggtaccggtccctttggaagatatcgtatgataaataaggattataagtaaaacatataatttttataaagttaaataaaaaacttttataataggagaaaattttatagcagaaaaatattttgggggatttcatatggatgaaaaggattggattgtgctcattacattattcgaagaaaaaaatatgacgaaggcggcagagcgattatatatgacacagccggcgttaagttatcggctcaaaaacctggaagcacaattcggagtgcgccttttttataaaagaaaaaaagggatggagttcacttcagaaggtgaacatctggttgattattcgaaagagatgctgcaggagttcagaagagtgaaggatgatatgctcaatatgagccatgaagtcagcggggttctcagattaggagtctcaagcaattttgctcagtataagctcccggcgattctaaaacggttttctgatcagtatccgtctgttcaattccacgtcaatacgggatggagtgcgaaggtgatggatctgcttcatcattcgggggtacaccttgggattatgagggggaattatgattggcaaggagaaaaacaactgctgaatgaagagaggctgtaccttatttcaaaaactgaaatcaacagtgaggaccttcccaaattgccgatgatttattatcaaactgatgcttctttgaaaagtttgattcaaaaatggtggaataaccaatttactgaaccgcctttcattgcaatggaggtagacaggcaggaaacctgtaaagagatggtgaaaaacggcctcggttattctgttgtgccggaaatctgtcttcagccttctgatgaattatacacattggcgctatcctataaaaataatgaacctgtgatacgcgatacttggctcatgtatgattcttcagcgttagaattatctgtcgtcaaagcattcattacttttttgaatgggaataaagcataaaaaaacctgcaagagacatcatctcttgcaggttttttgggcattacttctggtcttccgtattgcgtgtcagcactttatcgattaagccgtattctaaagcttcatcagctgatttgaagttgtcgcggtctgtatcgcgctcaatgacttcaagcggctggccggtacgttcagcaagcactttgtttaatttgtcgcgaagcaagagaatgcgttttgcggcgatttcaatttctgtcgcctgtccttgcgctccgccaagcggctggtgaatcataacttcactgttaggaagcgcgtaacgtttgcctttttctccggctgcaagtaaaaatgctcccatagaagcggccataccgatgcagatcgtggatactttcggtttaatgaactgcattgtatcatagattgccataccggcagtgattgatccgccagggctgttaatgtaaatggaaatatctttttcagggtcttccgcttcaaggaataaaagctgtgacacgatggagttcgcaacgttgtcatcaatcgcagatccaagcatgataatacggtccttcaaaagacgggagtaaatgtcataagctctttctccgcggttcgtttgttcaatgactgtaggtattaaattcataatgctcctccttcaccttttaggtaagtatgtatttacatgatacatttttggtcaataaaggtcaaacaaaacgctgaccaaaatgccaaccttttcttctaacaccatttttcccataaaacaaaaagttcaaacagcaaagtgaaaatgaggatgatcagcgccggagccttgagaaaatgatatggccggagcgctcaaaatagaccgcagtcgcgtcggtacatacggctgaacggtctgactacgttgtccgtccttccaaaagccgtaccggcaaatacgtttccagcggcaaatcatcaaattcgccttcaatttcttttgctaaaatctcgatggctgttttggaaatcaattcgatcggctgctggatggttgtcaagtccggcagaaccgattgaacggtttcagtgccgtcataaccgatcacttttaattgattcgggaggtctttcccccgttttttagcctcggtcatcacggcagccgccatgatatcatcgctggcaaaaattccgtcggtgtcaggctgttcatcgaataatgttgaaataatatcatggtaatgctgataaaagggtacttcatatgtaataggcttccgtccgtgttcatgcatgacgtcttcgtatgcttttcttctgaggtttgccggtgtttcgagttcaatcgggccgttgagatggacgatgtgccggcaccctttttcaatcagcagttcagccgccttttttccgccgtcatagttgtctgagccgacgacgggaatcgtgtccgataagtaatgatcaatggcgacaatcggcagattctgcttgtgataattgagaattccccggttataagtcacggcgatcacgccgtccacttggtttcttatcagcatctccaaatatttttcttccttatcctttcgatgtaaactgttgcaaagcagcagtttgtagcccatggacgtacaaatgctttcaatatgaaaggcgagttcgccgaaaaacgggttgctggagtttgggatgataagtcctattaaattggttcgttttcggaataaagagcgggccagatcgtttggaaagtaattgatttcttccatcgccttgtacactttttcttttgttttttcgctgatatagccgcggttatttaatacccgcgaaacggttgtagatgaaactcccgctattttcgcaacatcatgaatgttaggcttcattcccgtgccctcctgcatactgaaatggcttacaatttccgtcacgcacttattttagagaatcaggctgacatgtgcaaggacattccatgtttctgttttcatataaagagggtgcgttttgtttgattggaataatcagaaaatcatatgtcaaccgattgacatatgaaaccggttgacatacaattctttttgaaagcgctttatttacggagtgaagggaagtgacgggtatggagagatggctggcggcaataaagtgaaagaatcaagcagcggcggaaagtaagcgcttactcggagctcgcatgtatgtgatgaatatgaagaaggaagtatgcggctcaaaatgactattaaaaggtcctattaaaggagcggtgcaaatgaaaagctcaaaaagtctgtattggaaactgagtgcttatttcttctttttcttttttacttggtcttccagctattctttatttgcgatttggttagggcaggaaatcaatttaaacggatcagcgacaggcattatcttttctgtaaacgccgtatttgccctgtgcatgcagcctctttacggttttatctctgacaaattggggctgaagaaaaagatattgtttatgatcagctgtcttctcatattcacgggtccgttttatatctacgtctatgggccgcttttacaatacaacgtctttcttggcgccgttgtcggaggcttatatttgggagccgcttttttggcgggaataggcgcgattgaaacgtacattgaaaaggtcagccgtaagtatgatttcgagtatggaaaatcaagaatgtggggctcgctgggctgggcggcggctgcattttttgcagggcagcttttcaatatcaatcccaatatcaacttctggatcgcgtctgtttcagccgtcatattaacggccattatcatgtccgtgaaaatagaaatgaccgatcatgagaaaaacagagcggaatcggtccggttaaaagatgtggggcggctctttttattaaaagatttctggttttttatgatgtacattatcggggtgacttgcatttacggcgtttatgatcagcagttcccgatctactatgcgtctttgtttccttcagtgtcgatgggtaaccaagtattcggctatctgaattcattccaggtgtttttggaggccggcatgatgtttcttgcgccttttatcgtcaataagttcggagcgaaaaacagtttgattttagcggggtttttaatggctttccgcatcgtcgggtccggaattgcagttgagcctgtaggcatttcatcaatgaaactcatccacgcactggaattgccgattatgctgatcgccgtttttaaatatttggccgccaattttgatacgcgtctgtcgtccgtcctttatctcgtcggttttcaattcgcatctcaggcaggcgcgtcgattctgtcgccgcttgcgggaggattatatgacagtgcggggttccgtcaaacctatctcatcatgggattcgtcgtctttggttttaccgtcatctccatatttactttattgggcccgaaacaaaacagcaggcgtgtccagcgtctgcaaaaaatcggatagagaggatgttacaaatggacagaattcagcaggcggaagaagctttgaaggaagccgagggtaaagtgaaacaaagatatcgattggggtatcatattatgccgcgggcgaattggatcaatgatccgaacgggcttattcagtttaaaggagaataccacgtcttttttcagcatcatccgtatgatgagcattgggggccgatgcattggggacatgtaaaaagtaaagatctcattcattgggagcacctgccggttgccttagctccgggggacgaattcgatcaaagcggctgtttttcgggaagcgcggtcgatgatcatggaagattagcccttatctatacaggacataatataattgatcaagagaaagacctattctatcagactcaaaatatcgctgtcagccaagatggaaccgtgtttgaaaagcttcaggaaaaccctgttattacggaaccgccggaagacagcgcccgtcatttccgcgatccgaaagtatggaagcatcgcgatgtttggtatatggtcatcggcaactcttcaaaagaaaacgtcggacgggtcgttttataccgttcacctgatttgcgtgattgggaatacgcgggggttctcgcccaaagtgacggtaatctcggttatatgtgggaatgtcctgatttctttgaattaggcggcaaacatgtcctgctgatttcgccccagggtatcgaggcggacggcgattcatataacaatttacatcaaaccggctatttaatcggtgactataataatgaaacaaacaaatttacacacggcgcttttaaagaactggatcacggccatgacttttacgccgtgcaaacattattagatgataaaggacgcagaattgccatcggctggatggatatgtgggaatctgagatgccgacaaaagcggacggatggtgcggtgcactgactttgccgcgggaactgactttgcgtgatgatcataaacttttgatgaatcccgtggaagaaaccaagcagctgcggaaaatggaatatcgggaatgtgccggacgatcggtttcagggagttacttggcaaagacgcccgaagacctgcttgaagtccgagccgtgtttgatgtaaacgattctgatgccgaaacggcaggttttaagattcgcggccttgacgaagaagaacttgtgctgacatacaatctaacggataaaaagctgacacttgattgcaccaagatggggaaagacggtgtgagaagggtgcggctggatgcaaacggcaagctggcgctgcgtatctttattgacagatcctcgattgaagtattcgccaatcatggagaaacaacgatgacaagccgtatctatccgaatgaaggcagattggggattgagctgttttctgagaaaggcgccgtaaaggttgaggaattcacctattggacgttaaaggacatttggaaaaaaagctgaaacgggtgattatcgctttttctgaagcggctggaaatgtaccgagccgagggcagtccgcctgaaatacattttttgtgaaaatcaatgccgttaaacgatgcaggattatgcagcgtcctcgtgcagcataatcctgttgtgtataatcaaaaaagagttgctttctgtgcgtttctttattataatataaaggtatctgattgaaaaaacgtgcgctcgtagctcagttggatagagcggtggtttccggtaccacgtctgtcgggggttcgaatccctccgagcgcgtctcagttaagacgataggaaaaacctcgcagatgataaatctgcgaggtttttattttatcttgttttgaaactgttaatgaatgtgtctctgttatgttcggtgccggcaatcagccgcgcactttcactgatccgctgcgcaagagctttttgcgccttgccttcaaagctgttcaatagtgctgaatacacttcatataattcatctttcaatgtgtccatttcgaatgtcggtttcagcgtttggcgcactgtttccagttttgtccccgctgcctgcgtcatggcggttttcagcatctgccgctgcagccttttcttcatcgggtcgtccttgtgttctaaaagttcgtctaatgtcggcattatgtatccacctctatcatcttaaccagtttgcgagcatctggtctttttcctgaaattcgtccgctattttatgtaagaatccgccgatctcttcaaggtccgtgatcgccgcctgcaaagaatcaataaacgcctgctcagcctgtgtgtcgtaaaaaatcggtcctttatcgtaggattgcgcaatatcttcaattgtattggtcacgtcctgtgcttgaagctgatcaaacaagccgtgtccgacttggccgtaaaattccgttttcagctcggcgattttttcatcgtgctcctgataggcgttctgcgcttcttttttcatcgtccgcaaatcctcagtcatggcctgcaccttttcagccagcttctttgcgtttttcggcgttacttttatcgcgtctccgcttccgatcgcaccggccggcagaagagcgccgagatttttatcgaagactaactcatctccgttcggatttgtgatgtttccgtttcggtcaaatatgaaattcgcttcatttaagccgtgtgtatccggatttctcagaatgacggtagtaaagaaataagcgagatttttgccgatctgctcgttcaagttcccatcaagccgctgcttccggctgaactgtgagagtgaggggtttttcgtataaatcgttgtcccgttgtggcggtcatattcgttccaataacccgccccgaccatgtcgtccggattgataattgaccggatgtaaggatcgtatatgccgctgttgatgtctttctgtgtttcctcatcgtgcagtttcacgacggaagggctgttaaacgcgacggcgtacacatcattattcaccgcgctgtattcggcctcagcgccgccgagtgaatggccggttgttgaaataatcgttgatgttccggcatactttttctttacgctgcgtaccagctgatcggcttgatcgatttgcgatgttttcgttatcagcttatactttccggttgtgagcatggcgtcttgagagggcgttccattatattttccgagtgttttcgaggtatcctccgcgtctttttttacaatataatacacttctttttgcggatcattaccgaaaacaatattgccgccgtccgcttttacgccgtcattgatcgggtcttttccgatatcggttcccgcaaaagcgacgaccacgttttcggggttttttgattttatccattttccgtttttggacttgatgccttttgagaatacaaaggcatcaagacccgtatcagaatcctgcttcactttctcaacgtaccaatatgacgtcttacttattttataaggagttttatatttcatatgcagggctaacattttataattgtaagctgcttgactcaaacggtaatattctttatctgtgacatcagagacggttatttcttttccttttggcatatatacatcacctttcttatattgtaaaatagttccgaaaggatgatacgcatgagaaaatacattattatcctaattgttataattatagcagtgggaggttttttcgtgaagcatcaatatgataaacataaaaacgaagaaaaacttgtgattgaggcgcaagatcatatgaggaattacttaaaaaaagactataaaaatgtacaggaagttcacttttcaaaagactacaatatcgatccgacaggcggagttgaagtttcaggctacataaataataataaagaaaaagaattttccggtatatatgatccaacgaacaaggagataggtatttcagtggtcaatgccgaagaaaggtaaaatacccacctcaggatgagtgggtatttattttgtttaattatcttacaaaattcgtgatatgtttctcatacagttcaaacctattcctgagatcaatcgcctctaccgtctcatttgtcgaggtatccccgatattaacggtaaacgcgtacaaatatcatgacaactcaacgacaggaaaacgtcagatcagcattttactcgctttaagttccaatcttaacttgtcagcaacaatcgcgatgaattctgaattggttagctttgcttttgacatgctgaaagtatattcatatcaagttttcgctcatttcgtttacttaagaacgacagttatttataggaagggtttgatttccaaatgaaaaagaaaaagtacataattatccttattttaataattatagcagttgggggactttttatgaagcatcagtatgatcagaaggaaaaagagattgcgttattcgaagaagcccagaatcatatggaaaagtttttaacaatgaactataaaaatgtggataatatccatttttccgatgattaccatattaatccaatgggtggtattagtattaagggttatacgaatggaaaaaaagagtttgaaggtctatatgatccaggcaataaagaaatattatcatatacggttgatgccgaacccaaagaagaatgtaaagataagctttgtacaagataaattagccagctcaatcgagctgagctaattttgttttattgctcttactctatctcctcgacataaaacaaatcttccataggtacatttaatcctcagttaataatgaatagtgttgtgatatcatatcttgtatttgttttaaatctgcttatcgcagcctcagtagaaccaactaaatcagccaattccttctggatttgaattcctttctccttcatcacttcatttaacctagatctaactataactaacgcttataaaaaagtattctcgatcactgatacttgatacgttgatgttttttagacatgtacaacaccccgaggttgatataaatttaatctaagaaaggatgagtttgtgaagagatgcaaaattgccctaatatttgtgataactatagcgtcaggaagtatctacatgaagtaccaccatgattaaaaagaagcagaacaagaactttttatccaagcgaaaaataaaatggaaagttatataaaagctaattacaaaaatataaagcggattacatacattaacaattataaaataaatcctatgggtggtatttccttgaaggggtacttgaatggtaataaggaaaaagaatttttcggactttatgacaaaacgaatgatgaaataggagtttcgtcagtcgatgcagaagagaaacccgaatgtcaggaaaaagaatgtgaatactaaaaagacgctggaataaagaagtactctggattgccgcttatatgatcctctgcggacattaaagaaaaatcttaagaccctaaatgcatcggatgtcaccaccatttttccattccgcgagcttcatcataactgatgggacggatgattctgtgaaaaaatatattattatcttcattatcttaatagcagccggaggttttataatgaagagtatgaatgataaaaatgttcaggctgaagagataaagattgctcaagaacgaatggagaaatttatcaaagcgaattatgaaggcatacataacgttacatttaaagataaatatgaaacagatccaatgggcgggatagaggtatttggctattacaacgatgatacatcaaataaatttgacggtatttatgataaagcaaatgacaagattatgggacacactatagatgctgtgagaaagaaagaatgcagagataaagattgtgattactaagaagacgctcgtctgcgtttttttatagatgagcttaatgaaaaagacaagggtttcggcatgtgccgcccttgtcttttttattgaacactgtaaaacataaccggaaacagctcattatttgacagtccattttaacagcgttacaattaatcatgtaaatagttacatgtttaaacaaacatattgtctcgggaggtgatacgtccttgaatgaaccttctttaaaaaagtcatttatgagtcagtgaaacgcatcattgatcccgagcacgtgtatttccgcactgtgcctgtgtttgaaacaagcaatgaggcatatcagcatctgcaggaccggctgtttatcggggctgcggtcagattgccggatgacattcggttagatatttatgaaattcaataataagatggagagtgagtcaacatggaaaactttatcggaagccatatgatttacacgtatgaaaacggctgggagtatgaaatctatattaaaaatgatcatacgatcgactatcggattcatagcggaatggtaggcggccgttgggtgcgcgaccaggaagtgaatatcgtcaagctgacagaaggcgtatacaaagtgtcatggactgaaccgacaggcacagacgtttccttaaactttatgccgaatgaaaaacggatgcacggaattattttcttcccgaaatgggtgcatgagcatccggaaatcacggtgtgctaccaaaatgattacattgacgtgatgaaagagtcacgtgagaaatatgaaacgtacccgaaatatgtcgttcccgagtttgcggatattacgtatcttaacaatgcgggaatcaataacgaaacattgatttcagaagcgccatacgaaggaatgaccgatgatatccgtgcgggaaaattaaaataagagaaaaaacccggcagcttggccgggttttttgtatccttttacgagagggttttggtcatgataaagtcgacttgtttatcatcccccatataaaaagagtgttctccggtttggacaaaccccattttttgataaaaggcgattgcattttcgtttttttcccatacgcccagccagatgttctttttattgtgtgctgttgcgattttcacagcttcattcagcagatatttgccaagcccgtgtttctgatggctttttcttatataaattctctcaatctcaagagaatcttcccccattttttctgactgtgcttcgttcatgttgacttttacataccccgcaaggtcatgatgataataaacaaaatagaattgagaagacggattggataattcctttttcagctgttcagagcggaatgcattttccaaataagctttcatattttcaggtgaattttgatctttaaatgtatcattgaatgtttcaatgcttatctcccggagctctgttatatcgttaaggctgcacttttttaatttaatactcagggtcatacagctcctttcttcatttatcataccagctgaattttgttgtatttgcaatgaaaataccgtatagtaaacataccgtaattttgttgtatttgcaacataaaataagaaaatgaggacgataaagtgaaatatgttttttatgttttaggaatcatgatcttgacctttggtatttctgtcacgattcaatcagatcttggaacatcgccttttgatgcgcttattgtgggattgtccgtccatgcagggcttaccgtgggaagctgggaaatcatcatcgctttcctgttaatttgctgtaattcaatgttaaaaaggcaaagaccggaattttcagggatgattacggcgttcataacgggaatcgggattgatatgtggcttttttttctgcatcgagtcataacgcctgaactatggtacggaaaggcgggctgttttgcaatcggtttagttgtgatagggataggaaccgcaacctatctgcacacaaatttcgcaccgatcccggttgatcggttaacgctaattgtccgtgatttaaccgggagaagcatctttttttcaagaacggtcatttacttcatatttttcatactggccttgatgctaaaaggtccggtaggcatcggaacgttattaaccgtttgtttaggcgggatcttccttcatttctttatgccgattaccggaagatggatagacggcatattaacagcatctccaaagcaggaaaaaacgaaaacccggtaacggcggtttttacccgattctatcatttttcatttcacccgcatgtttaaggtataataaaaaagggggagggatttttatgagcggtcaaagaaagctcgttttttacggagctgtcagcgcagatggctatcttgcgcgggaaaatcattctttagattggttaatcggaactgaaggtgaagacagcaccgattatgaagctttctatgaatctgtcgatacgatcattatgggcagaaaaacatacgaggaaatattggttttattgcctgaggaatttccgtacaaaggtaaagaatgctatgtgttttcgcggacattgaccgggcgtactgaacatgtgcggtttattcatgaagagcctgccgattttataaatgcattgaaacgccaagaaggcaagcggatttggattgtcggcgggagtgatctgctgcacccggttttggaggaaaaacttgtcgatgagtttatcattcagatcgcccccgttctgctcggccgcggaatttctttgtttaaacccggagaccgggagacaggactgaagctgactgatgtcaggcgttacaaacaatttgcggagttgcattatgaagtgagataaaatgaaatgtatgaacgaaacccagtaaaggttaccgggtttctttttcatgtttgtttttatgttttgaaatggtgtgggccggaccgcatgaaaatcctgcaaccatgataacaacccctatccacctcacggcatagaaatcagtgtcgcgcaggaagataaatgaaactaagataataagcgccccgattataacggcagctgtgccgataatacttgatttctccatatagaaactcctttatgaatgtttggttaacgtattgggttggaatataacatatcaggggtaatgcggaaatggatatgctgcgaagctgactgatgtctgtaagatgaaaatgaaacgccaagggagccggctcccttggcgttttttatgcttgaaacaggatgcggcgttttgctgaatcgggatcactttcgacagcggtatccgtgttgaaaagcaaagtttcgcgtgaatcggtttcatattcaggccaattgaagtgagaggtgttcgggtttccggtttttgcaaaagcgagccatgcggattgaatttgtttggaaagctgttctgcgtcatcaccgagcggctcttgcagcgtctttctcaaagaatcaaagtttccgaacacaaacggcaattccagagcgtgaacggctttatgaaacggcggtgtttcgccatgccaatcaaagcggtacatccagaccggtgcgtgttgcgactgtccttgtgcgaaagcgacagccggccgccagaaaatcagatccgtcatcatatcgatttgtccctttaatgaatgcggatataaatctgccgcttgctcggtgcagttttctccgaggtgataatgcaaataatcttgctgctttttctcggagtgaatgtctgtatcaggggtgaaaaacaaatatgcttcatcacgattggttccgatgatcataggtatgccttctgcggccccgtctgctatggctttcaccggttccgcaggcaatgtggccggatcgatggcgggctgaaacaaaagctgaaaaatgttttgatccagtgagcgccgcactttatccgcagtcttaagcaggtcattaacggaaagctcctgcaattgatcagtgccggcttcatgaataaatgccgccgcgatgtcttttgccatatccgccggcatcgtatgagaggcgccgctttctaaaatggctttatgaaacaggccttttgcgtcaggcattgccataagcgcagcgatgctcatgccgcctgccgattcaccaaatatcgtgacgttatccgggtctcctccaaattcggagatattgtccctcacccagcgcagcgcggcgatctgatcgagcagcccgatattggcggaatacgcgtcatgaatagaagacaaatgtaaaaagcctaacggtccgagcctgtaattgagtgtcacgacaatgacatctccgtcagcggcaagggcagatccgtcgtaaagcggttcgcttccggcacctaaataaaatgccccgccgtgtatccataccatgacaggctttttttcgccctctgaatcgggggcgaaaacgttgaggtaaaggcaatcttcagattgaggcggtatatctccggaaaacgatatggacagcatatcatccggctgcggacaaatcggcccgaacgaatcggcatgttttatgccgtcccaaggtgcgggcggctccggcgctttaaatctcagctctccgacgggcggcttcgcgtacggtatgcccttccatgtgcgggcaccgcggccggcagttcctttcagtgcgccgcagcgggtttgaacggtaagttttgtcatgatttcatccccttttttcttttcattataaacagagatgaaggcatgaagcgaataaaagccctttcatcagcatatcatcagtaacgcttccgttctaaaaatgatctgacttcctgaacggacaagccgagttcttttgcttcctgcatcagcgctttccattcttcaatgttggattcagtcagttttctgttacggtaggatgcgggctccgggcgcttttcagtcagtttgttcgtaaaggtgaacagttcttctttcggcatgcccgactgcacggcctgcacaaggtggatgcgccactcatcttccgtgcctcccatgtgatgcagcatcgtttcggcatcaaaaagctccgtcagatcgacctgcagggtggcggatacttttttcagaaattggatggacggatttgagtgaacccccgttctatcttgcttaaataagatttagagacacctgcttcaactgctagctgattaatagagtagccttttcttctgcggtataaacgaattattcttccaatcattgtgctgaattctcccctgtatactggcatttttttgttcattataagaaatttttcgttctttataaaatttaaaattataagggaagtgcagtaaataagaggaaaatcatgataatgttctctaaaaagaactaaatggcttaatttgaaattttcaaatttcgaccttttcttttataatccaatcattaacagaagggggcgtttaagcctgatgcaataaggatgaggctgtaattacatgaatgagaatatgagttttaaagagttatttgacattattaaacacagatttttactgatttttatcatgacagcagttgtaacgctgatgacgggatacatccaattccgggtgatttcgcccgtttatcaggcatcgacccaagtgctcattcatgaaacaagcggtgaaaaaaattcgaatctcagcgacgttcagctgaatcttcattacaacaatacgtttcaaacgataatgaaaagcccggttgtgcttgagaaagtgaaacagaagctgcatctttctgagacggcatccgctttaaaagcaaagatcacgacaagcagcgaaaccgattcagagatcattaacgcagcggtgcaggacgagaacccgaaacaggccgccgctatagcgaacacgctgatgaagacatttaaaaaagaagtccgtgacaggatgaatataaaaggcgtcattgttttgtccgaggcaaaagcatcggaaagcccgatggtcaagccttcgcgcatcaggaatatcatgatggcgttcggtgcggctctcatggcgggtgtgacgcttgcgttttttctccactttcttgatgaaaccgttaaaagcgagcggcagctcagcgaaaaaacagacttgcctgttttaggggttgtgtatgacatcaaaaatcagcagacacggtctgatgaaaaacatttcggggagtgaggcgtttgggattcagaaaaaagaaatcaagaaggggactggctcaaatatccgttttacatcacaaatcattggtggctgaacaatatcgcaccattcggacaaatattgagttctcctctgttcagacccatttgcgctctattctcgtcacttcctccgttccgggagaaggaaagtcattcagcgccgccaaccttgccgcggtatttgcgcagcaggaaaaaaaggtgctgcttgtcgatgccgatttacgaaaaccgacgatacacgagacctatcagcttgaaaatgtacaaggccttacgaatgtgttagtcggaaacgcttccctcggcgaaacggtgcaaaaaacgctgattgataacctttacgtcttaacgagcgggccgacgccgccgaatccggccgagcttttatcttcaaaggcgatgggagagctgattcaggagatgtacagccggtacagtctggttattttcgattcacctccgcttttggcggtggcggacggccagattttagcgaaccagacagatggaagcgttctcgtcgtcttgagcggaaaaacgaaaatggataccgtccaaaaggcgaaagacgcgctccagcagtcaaaggcaaagcttttgggggcgctgctgaataaaaagaaaatcaaaaaaacagagcactactcgtattgagcggtgcaggtgatgtctccttacctttatcaacggaggcactcggctctgctgtgggcggcgttttccgccgccttagatgctggtcgtcggtggcggggtgtgaggacgggttaaatgcccaatttatcttaagatgatgcattgttatcggcttagctgttatgtctgtttttacgaaaaccgtatcagctaaaccgataaatgaggaggggaaagattgacttaccggagaagactttcaatgatttttgcattggatacgtatctcgttttactttccgttgttataggatatcaattttttgaggattcttatcacttttatgactccggagcgttgctgctgaccgccgtgaccatgctgatcagccatcatgtatgcgcttttatgtttcaccagtataagcaggtatggacgtatacgggaattggcgagctgcttgatctgctgaaggggatcacgctgtccgcagctgtcacagccgccgtccaatacggggtgttccacacgattttgttccggctgttagccgtcagctggatggttcagctattgttcatcggaggaagccggatgatttcgcgcgtgctgaaagaaacgatcggcaggaagcaaaatgactcttcccgggcgctgatcatcggcgcaggcgcgggaggaacgctgctcgtccgtcagcttacgcagaaaaatgatctcggaatcatgcctgtggcttttattgatgatgatcagacgaagcataagctcaaaatcatgggcctgcccgtcatcggcggaaaagaaagcattatgccggcggtgcaaaggctgagaattcaccacatcatcatcgccattccgtctctttgcacccatgagctccagacgctgtacaaagaatgtgtgcagacgggcgcccatattaaaatcatgccgcaatttgatgagatcctgctcggaacgcaggctgccggacacatcagggatgtgaaagccgaagatctcctcggcagaaagccggtcacccttgatacgagcaaaatttctgacagcatcaaagggaaaacgattctggtcacgggcgccggcggctctatcggttctgaaatctgccgccagatcagctcgtttcttccgcatgaaatcgtccttctcggccacggggagaacagcatttattcggtgcataacgaactgtccgcacgcttcggcaaagaggtgctttttcacgcggagatcgccgatattcaggacagagataaaatctttacgttgatgaaaaaatacgagccgcacgtcgtctatcatgcggccgcccataaacatgtgccgttaatggaacataatccggaagaagccgtcaaaaacaatattatcggcacgaaaaatgtcgccgaagccgccgatatgtgcggaacggaaacattcgtgctgatttcttctgacaaagcggtcaatccggccaatgtcatgggcgcgacgaagcggtttgcggaaatggtcatcatgaacctcggaaaggtcagcaacaccaaattcgccgccgtccgtttcgggaatgtgctcggaagccgcggcagcgtcattccgattttcaaaaagcagattgaaaaaggcggacccgtcaccgtcacgcatccggcgatgacaagatattttatgacgatccccgaagcgtcaagactcgtcattcaggcgggggcgcttgcaaaagggcggcagattttcgttctggatatgggagaacccgtcaaaatcgtcgacttggcaaaaaacctgattcatttatcaggctatacgacagaacagattcctattgaattctccggcatccgcccgggagaaaagatgtatgaagaactgctgaatcataatgaagtacatacggaacagatttttccgaaaatccatatcgggaaagcgatcgacggggattgggccgtgctcatccgttttatggaggaattcagccgtctgcctgaagatgagctgagaaaacggctgtttgaggcgatcgaatcagtacatgaagaagcggccgcaggtgtgtgatgggaggacagaaagatgacgaaaaaagtattattctgcgccactgtcgattatcattttaaagcctttcatcttccgtattttcaatggtttcaggatatgggctgggaggtgcacgtcgcggcaggcggcaatatgaatcttccattcgttgatgaaaagttttccattccgatccggcgctcgccgtttcatcccgaaaatctttctgtttacaggcggctgaaacggctcattcaggctaacggctacgacatgattcactgtcatacgccggtcggcggcgtgcttgcacgccttgcggcgagacaagcgcgccaaaaagggacaaaggtgctgtacaccgcgcacggctttcacttctgcgatggagcgcccctgaaaaattggcttctttattacccgatcgaaaaatttctctcttcttacacggattgtttgattacgattaatgaagaggattacgaacgggccaagcaaatgaaaaaaacagcttgcggcgcgaagaaaatacacggcatcggcgtgaatacagacaggtttcgccctgtgagccgggcagagagtgaacgtctgagagaaaaacacggcttcggcgccggggaatttatcctcatataccccgctgaattaaacggcaataaaaaccagggacttctcattgaggctgcggcactgctgaagaaccgcattccggagctgaaactcgtatttgccggagaaggcgcgatggaagagccgtacagaaaaaaggctgaatcactcggggtatccgacattgtgcggttttacggtttttgccgtgacattcatgagctgattcagcttgccgatctgtccgtcgcctcaagcatccgcgaagggctcggcatgaatctgcttgaggggatggctgccgaaaagcccgccgttgccgcagacaacagggggcaccgtgagatcatcgaagacggtgtgaacggttttctcgtgccggcaggggacagcgcggcatttgccgatcggattgaaaagctgtaccgatccccgggtctgcgaaaagcaatgggacaagaagggcgcaggacggcggaatttttttcagaaacacgtacggtaaaggaaatggcgcacatttacgccggttatatggataaaaaggagaaaagcgtatgaatgcaggagcacaaccgaaaatttccgttatcatgggaatttataattgcgaagagactttagcggagagtattgaatccatcctgagccaatcgtataagaattgggaactgattatgtgtgatgacgcgtcaactgacggaacgtatcagattgcgcgccgttacgcggatcattacagcgaccggatcacgctgattcaaaataagacgaatcaacggcttgccgcttcgctgaaccgctgtctgacatacgcaacgggggattatatcgccaggcaggacggtgatgacatctccaacccgaggagactggaaaaacaggccgctttcttaaacaagcacgcccactatcaagtcgtgggcacggggatgctcgtatttgatgaattcggcgtcaggggcgcccggcttttgccgcccgtgccgaaaccgggaattatggcgaaaggcacaccgttctgccacggcaccattatgatgcgggctgaagcgtacaaagcgcttggaggctaccggtcagtcaggcggacgcggcggatggaggatatcgatttgtggctgcgcttttttgaagcgggtttccgagggtacaatctccaggaaacgctgtataaagtaagagaggacagtgatgcgttcaaaaggagatcgtttacgtattccattgataatgcggtgctcgtttttcaggcatgcagacggctgaagctgccgatttcccattacgcgtatatcgcaaaaccgctcatccgcgccattacgccgcccgcggtcatgaaccgttatcataaaaacagggacatccgccaaaaagaagggcttgccgaacatgactgacaaaccgatgcgggtgctgcacatcttcagcgggatgaacaggggcggcgcagaaacgatgatgatgaatttgtaccggaagatggacagaacgaaggtgcagtttgattttttaacccataggaacgatccgtgcgcttatgacgaggaaattctcgctctcggcggacggcttttttatgtgccgagcatcggcagcacaaacccgattacatttgttaaacaggtcaagcgggtgattcaggaaaaaggcccgtttgccgccgtgcacgcccataccgattttcagtcgggatttatcgcgcttgccgctcgtttagccggcgtcccggtgcggatctgccattcgcacagtacgtcgtggcgggggcgggcgtcgcggcttgccgggatgcagctgtttgttttcagacggctgatcacggcaaacgccacggcactgtgcgcctgcggaaaagaggcgggccgtttcttattcgggaaagaaaaagacgtgcatcttttgccgaacggcattgatctcgacttatttgccggcgggtgcgcggacacagaagctgaaaaaaggaagcggggcattgcagacggccgtttggtgatcggccatatcggccgctttacagaagaaaaaaaccacgaatttctgctccggctggccgctgatatgaaagagcggggcatcggcttacagctgattctcgccggagacggtccgcttcgcaccgatatggaaaatctggcggcgaagctggggcttgatgatgatgtgcgttttatcggcatagaagaccgcgttcatgatctgctgaaaacgctggatgtatttgtcatgccgtctctttatgaagggctgcccgtcacgctcgttgaagcgcaggcctccggggtgccgtgcgtgatatcagacggcataacggaagaagccgatgccgggctcgggctggtcaaaaggctcagcctcaaagaaccgccgggacaatgggcatccgcggttttacgggcagcagaggcggcaaagcctgacggggcgcgtattaaagaaaccctcaggcggctgggatatgacgcgggagaaaatgcgggggctgttatgaagctttacaatatgaattggaaaaaggaacagtaacgaatgattgtatatgtagtcaatatgggaattgtttatatttggtcatggttcgcgaaaatgtgcggcgggcgtgatcaatcgctttcgaccggataccggccgaatcagctcgtcatgctcgttccgctgctatcgctggtattggtctccggtttgcgctacagagtcgggacggattttcagacgtacgcgctaatgtacaagctggcgggaaattacggcagcatttgggagatcttcgggttcggagcgaaaaaagcagccgttgatccggggtttacggctctcatctggctcatgaattttatcacgaaagatccgcaaatcatgtatttcaccgtggcggtcgtgacatgcagctttattttaaaggggctcgttgagttcggccgtccgtttgagctgagtgtatttttgtttttgggcacgtatcactattacgcttcctttaacgggatcaggcagtatatggtggcggccgttttgttttgggccgtccgctacgtgatcagcggaagctggaagcgttatatgtcaatcgtgctgctgtgttcgctttttcattcctcagcgctgattatgattccggtttattttctcgtcagaaaaagagcctggtcgcccgcgattttcggactgtcggcattgtttcttcttatgacgtttctgtatcagaagttcatttcgctgtttgtcgtcgtgctggaaaacagctcgtacggccattatgagaaatggctgatgacgaatacgaacgggatgaacgtcgtgaaaatcgcggtgctgctgctgccgctgtttttggctttctgctaccgggagcggctgcggaagctctggcctgacattgatgtcatcgtgaatttctgtctgctcggcctgctcttcggtcttttggcgacaaaggatgttatttttgcccggtttaatatatatttcggcctgtaccaaatgatcctgatcccttattttgtgaggatttttgatgaaaaatcaaatgcgctgatttatatcgccattattgtctgttattttctttacagttacttgcttatgccggtcgattcgtctgtgcttccgtacagaacgattttttcccggtaatggacactggaggtttatatggaaacacccgcggtcagtttattaattgctgtgtataatacggaaacttatttagaaagatgcttagattcattgctcaatcagtcgctcgccaatatcgaaatcgtggccgttaatgacgggtcaacggatcaaagcccggcgattcttgaaacctatcagaagcgggatgagagaatcagggtcgttcatcagcaaaaccgggggctcggcgcggtccgcaacaagggcatcgaggcggcgcgcggcgaatttatcgcttttattgatgcggacgactgggttgaacctgattattgcctgcgcatgtatgaaaaagcgaaggctgatcaggctgatctcgtgatttgcgaatatgcggctgaatttgcggatacggggaagaccgccgtttcaacgatcgcttcagcgtacgagggccgcccgaaacaacggtacctgaaagatttatttgaaggaagagtcagcggcttttcatggaacaagctgtacaaaagatccatgatcgagcatcatcagctgcgctttccgcttcgtgatgagctggagcacgtggaggatcagtatttcagcctcagggcgcatgttttcgcaggtgcggtctcgtacgtggatcagccgctctatcattatcggattcacttgacttccattgtgcaaagctatcagaaaaagctgtttgactcaggtctcgttctctatcggctgaacgaggcttttttgcgtgaaaacggctgcttacacgaataccggcaggagctggattttttcatcgttcagcacggaacagtctgcctgctgaatgaatggaagcggaataacggcggccggttttctgagaagtggaagaatatcagccggatatgcgctgatcccgtattccgcatgagcctttccaaaacgggaacggcgccgtttgacgccaaacgctcatgccttctgcttttggcgaagctgaagctgattccgttcgtgtcgctggcatcagccgcgtatcagcgggcaatcgagtacaaaatgaaaatcagagggtgaagacatgtcgatacaatctttaaaaatcaatctcgcggaatggcttttgcttaaggtcaaatacccgtcccaatttcatttcggaacgggagcggatggggcggcggggcttacagcggcaagaaaaaagatcattctgacgctgctcccgtcccacgataatctcggcgatcacgccatcgcctacgcaagcaaaacgtttcttgaacgggagtatcccgattttgacattgtcgaggtggatatgaaggatatatacagatcggcaaaagtgctgatcaaaaagcgccaccccgatgatatggtattcatcatcggcggcgggaacatgggggatttgtaccggtatgaggaatggacgcgccgctttatcataaaaacattccggcaatatcggatcgttcagcttccggcgacggctcacttttctgaatcaaaaaagggacggaaggaactgaagcgcgcccgaaaagtgtacaatgcgcatcccgaccttttgttgatggcgagagatgagacgacgtatcaatggatgaagcgtcattttcccggaaaaacagtgctcaaacagcctgacatggtcttatatttggataaaagcgagcggggcatagcgcgggaagggatctacctctgtttacgggaggataaggagagcgcgctgacggctgaggacagaacgatggtaaaagaagctttggccaaagagtacggagagctgtattcctttaccacgacggtcggccggagggtcagccgccatacacgcgaaaaggagctggaagcgctttggaatacgctgaaaggcgcggaagccgtcgtcactgacaggcttcacgggatgattttttgtgcgctgacgaaaacgccttgtgtcgtcattcgttcgtttgatcataaggtgatggaaggctatcaatggctgaaaaacataccgaacatgacattgcttgaacgtcccgaccctgaagccgtaacatccgccgtaaatcggctgctcagcggcaagcatgaggaaggcggttctttgcgaagtgtttattttgccgggctgcgctcgaaaatcagcggtgatgcccaatgaccgcgccgcttgtgagcgtgatcgtgccgatgtataagacagagccttttattaaagaatgcgcggtttctttaacaaaacagacgctgaggaacatcgaaatcattttcgtcaatgacggttcaccggatcagtcaggccggatggctgaacaattcgccgcagaagatgcgagaatccgggtgattcataaagaaaacggcggcctcagctcggcccgcaatgccggaataaaagccgcccgcggccgttatatcggttttgcggacggcgatgattatgtgacggaaacaatgttcgagcggctttatgaagaagcggagaagaaccggctggatatcgccggctgcggttattacaaagaaacgccgtctaaagaaagaacgtatatgccgccgtcccttccgccgggccgcgtcttcacagcggatgaaatgaccgcattgctgacccgcgcgcacgaacatcggtttatttggtatgtgtggcgctatatataccggcgagaagcattgcaagggctgttgttccatgaagatatccggtttgccgaggactctccgtttaacttggcagcgttccgccaagccgcgcgtgtcaaagtgatagacgaagggctgtatatctaccgggaaaatccgcaaagtcttacagaaacaccgtttaagccccgcttagatcacgaactgcaaaagcaatatgcagcgaaaatggctttttatgaggcaaacgggctgacggacgcctgccggagcgatattgatacatatttgtgcaagcatcagattccgatgctgatcgccaacgcatgcgccgccccgcagccgtcacaccagattacggcgcatatcggcagaatcttaacgtatgacatggtaaaaacggccgtgcgcaggacgccgtgccgccataaacagctgctggccggggagcgcgtggtgctcggtctgtgcaaaatgcgccttcctcttcttctgcatgcgtttttcgaacggaaatcgaaagagaaaggcagtgcggaaggagcatgaaatttgccattaatttcggcgccaatgtgacggcgtttttactatcggtgtttttatcagtgtggatgacgccctttattgtgaaaacattaggtgttgaggcttttgggtttgtccatctgacacagaatatcattaactatttctctattattaccgttgcgctgagctcagtcgttgtgaggtttttctccgtcgccgcccacaggggaacagggacgaggccaatgcgtatgtaagcaattatttagccgcgtctgtcgtgatatctctattactcgctgtgccgctcgccgggactgctttttttattgacaggattatgaatgtaccggccgggctcttaacggatgtgaggctgtctatcgtaatcggcagcgtgctgtttatgctgacgttttttatggcggggttcgcgacggggccgttttttgccaacaagctttatatcacaagttccattcaggccgtgcaaatgctggtcagggtgctgtgtgtgctcgctctgtttacgtgcctgccgccgaagatctggcagatccagctttcggcattagcgggagccgtctgtgcagctgtgctgacttttttcttctttaagaaattgattccgtggttttctttcagccgtaaaactttatcattacagacaagcaaagtgctgttttcggccggtgcctggagttctgtcaaccagatcggcgtgctgctgtttctgcagattgacctcatgacggccaaccttgtgctggggccgtctgaagcgggtgtctatgcggcgattattcaattcccgcttctgctcagaagtcttgccgggacgcttgcttcactgtttgcgccggttttgacttcctattattcaaaaggcgatatggaaggtctcctgtcttacgccaataaggccgtgcggatgaacgggcttctcctcgcgcttcccgccgcgttattaggagggcttgccgaaccgtttctggcgatttggctgggcccgtcgtttgtgcagacggcgccgcttttatatattcacgccgcgtatttggtggtcagtctctctgtcatgccgcttttttacgtatggacggcttttaataaacaaaaaacgcccgccgtcgttactttatgtttaggcggactgaatgtcatattggccgtggttctcagcggaccggcacatctcgggctgtacggcatcaccattgccggggctgtctccctcattttgaaaaatgccgtcttcacgccgctgtatgtttcgcatattaccggctttcagaaaaccgcgttttacaaaggcatgttcggcccgttggcggcggccgtatttgcctgggccgtctgccggggtatccggctgttttcaccgcttgacggctgggccggtctgatcgccgcggggcttgccgtatgcataagctatgccgcattcgcttttttcttcatttgtacgaaagaagaaaggcggcttgctttacagaaatgccgaaaagtgaaaggagctgttcagatttgaaggtgaaacgtgtatttgatatagcggccgcgacgctgttattgtgcggcgcgagtgtcattcttctcttcgccatggcagccgtcagatgcgccatcgggtctccggtattgttcaaacagacgagaccggggcataacgggcgtccgtttacgttgtataaactcagaacgatgacggatgcgcgtgatgaaaacggtgtgctgcttccggatcatctgcgcctgaccaaaacgggaaggctgatcagaaaactgagcatcgacgagcttccccagctttttaatgtgctcaaaggcgatatcagtctggtcggcccccgccctttgctgatggattatctgccgctttacacggcggagcaggcgcggcggcacgaggtgaagccggggattacgggctgggcgcaggtcaatgggagaaacgcgatttcatgggaggagaaattcaagctcgacgtgtggtacgtcgacaaccgcacctttcttctcgacttaaagattctgcttttaacagtgaaaaaagttctcgtgtcagaaggcatacaccaagccggccatgtgacggcaaagcgcttcacaggcagcggagatatgtcatcgtgaaaaaggtcgtgctgatcggaaacggcggacacggaaaagtcgtgaaggaaatcgtgcaggcccgttccgatatggagcttgcgggcatattggacgacggattcagcggttttaccgctcggaacggtttatatacgggccggacggaagacgtgcacatgcttcggaaactcgtccccgaggccgtgttcacgatatgcatcggccgcaacggcgtcagaaagcagttcgctgaaacgcttgggattgaagctgccgattatgcttcactcattcaccccggggcgatcgtcagtgaaacggcttccgtcggacacggaacggttgtgatggcgggcgccgtcattcaggcgggcgctgacatcggcgcccattgcatcatcaatacgggggcggttgccgatcacgacaatgcaatcggagattacgtccatctttcaccgcgcgcggcgcttgccggcggagtgaaagtcggggaaggaacgcacatcggaatcggcgcgtccgtcataccgcagatggacatcggcccttggtccgttatcggcgcgggggctgcggtcatcagcagaattcccggccatgtgacggcggtcggcgttccggcccgcgtcatctcccctatccataatgaaaaaggatgatttcatgcaaacaaacaaacggatttatttgtctccgcctcatatgagcggaaaagaacaggaatacatcgcagaagccttccgaaccaattggattgccccgctcggtccgctcgtcaattcgtttgaagcgcggctcgcggaatatgcgggagtgaaaagcgcggcggccttaagctcgggaacggccgccatccatcttgccctgcggcttgcgggtgtgaaaaaaggagacgttgtattttgtccttcctttacgtttgtcgccacggcgaatccgattgtgtatgagcaggctgagcccgtttttattgattcggaatgggagacgtggaatatgtcgcccgctgcgcttgagcgggcgctccgggatgcaaagcggcgcggcagactcccgaaagcggtgatcgccgtcaatctttacggccaaagcgcgaaaatggatgaattaatgagcctttgtgacgcatacggcgtctgtctgattgaagacgctgccgagtccttaggatcaacatataaaggcaggcagagcggcacgttcggccgtttcggcatttattcctttaacggcaacaaaatcattacaacatcgggaggcggcatgctcgtgtctgacgatgaagccgcgattgaaaaagcgaggtttcttgcgtcacaggcgagagatgccgccgttcattaccagcacagcgagctcggttacaactacaggctcagcaacattctcgcgggcgtggggatatcgcagctggaagtgcttgaagatcgcgtccgggcgaggagagaaatctttcaccggtatcgggaagcgctcgaaacatatccgggcatccgcatgatgccggagcttgaaggaacggtttcaaaccgctggctgacggctctgacgcttgataacggcgtgacgccggaagaagccgtcgcctgtcttgcggaacagaatattgaggcccggccgctgtggaaaccgctgcacacgcagccgcttttctcatcttccgtcttttatcctcacagcgaccatgagcgtgtctctgagaaccttttcagccgagggatttgtctgccgtccgggtctgacctgtcttctgaggagcagcagcgtgtcattgacgcacttgcgcaactgtttgaaacgaaaggggagaaaacatggacagccgccatgttatgagccgattaaaagagacgctgacgggtctgctcagcgttataccgccgcaatccgacatcatatatgccgactatcccctctacggaaatgtaggggatttattgattatgaaagggacggaggcgttttttaaagcgcacggcatccgcgtgaaacagcgctggaatcccgacaattttccattcgggcgccgggcggacaaaaagacgatcatcgtctgtcagggtggcggaaatttcggggatctctatccgtactatcagacgttcagggaaaaaatcgtcaaatcctttccggaaaacaggatcgtcatcctgccgcaatcgatttattatcaggatgagacacggctgcaaaagacatcggcgctttttgcggagcacaaggatctccacctgtttacgagagatcatgtgtcatacgagactgcgaaacgctttttttcggcgaatcatatcgggcttatgcctgatatggcccatcagctgtatccgatcgcggcgtcagcggttccgtcacgcggcaggctttattttatccgcacggatggggaaatcaacccgaagctgcaaaacaattcttccgttaaaagctgtgactggcaggatgttctgtcagcaagcgaccgcaggggaatcgcttttttccaaacgctgaatgttttgaataaaaaagcgggaaacccgctgccgattgcgcggttttggaaccgctattccgatttcttaacgaaaaaagcggtcctgtttttcagcaggtacgaatcggtggaaacgtcaaggctccacggccacatcctgtcctcgcttctcgggaaaccgaataccgtcattgataattcatacgggaaaaacgcgaactattattacacctggacgcacgaagcgccggacgtccggctgatcggtgaaaccgccggcacgaaggaaaaccttccgctttgaatgagcggaaggtttattttgtttctccgcgttttactttgttgtacgcctcatccaaatgctgaattcttttgagcacaaccgagtttttcgtcagctgatcctgtacaagggttgagacgacggagcggtaatagctgttcatcgcatgaattcggtcttcattcggattcatttcaatgtgctgtgtaaagttttcaataaaatagggaacagaaaaaagttctgacatctataaagcaactccttttaataagtatatacggtatgaaaccaatcatgtacaatgaaaaaaggggagtgagcatgatggatatcaaacttcagcaaacacaaatgttaaagcctcaattaacgcaagagcttaaacaggccatcacattactcggatacaattccgcggaactggccggatatattgatgagctctcactggaaaaccctctgattgaacgaaaggaaacagacacgccgccactatcttaccataaaacaaataaaaacaggatgaaagaacgggacggaagccagcagatcagacttacccgcaaaacgctgcaggattcgctcaaacagcaagccttagacatgaagctgtccgatgatgagaaaaaaattttcaattatctgatacattcattggattcaaacggttatttaaaagaggacataccagccgccgccgaccatgtatccgcttcacaagaggagacggaagcggttctgaaaaagcttcaatcccttgagcccgcgggaatcggcgcccggtctttgcaggaatgcatccttcttcagctccgccgtctgcccgagcggaacgaacaggcggaatggattgccgaagcctattttgagctatttgcaagaaagaattggaaagcgcttacacttaaaacgggcattccgcttaaagacattcaggacatcgctgacatgatcagcgcgcttgatccgaggccggggctccgttatgcgcatgaggagccgggtttttacgtagaaccggatattttcatcacggtgaaaaacggcatcattcaagcgcggctcaacagccgttcgtttcctgacatccagcttcatgcccattatcagccgctcttgtcagccgccgggtgccgtgacacgaaaaattatctgtcggcaaaatatcaggaatggcgctggctgaaccgggctttgtcgcaaagaaaacaaacgatcacgagaattatcggcgtcctgactgaacggcaggaatccttttttctcacaggaaaaagcggaatgcagccgctgaccttaagagaggtggcggaaacgctggagctccacgaatcaacgatcagccgggccatcaaagggaagtacgttcagacgccgtacggactgtatgaaatgaaaacatttttctcggcgaaagctgaatcatcgggggacggcggcgcctccaattatgccgtaaaagcgcatctggaagcattggtccgtaaagaagataaaaagaaacctttttcagaccaaaagcttgccgatctgctgcatgaacaatatgacatccgaatctcaaggcgcaccgtcgccaaataccgtgaccaattaaatattccgccgtcatcggcgagaaaacggtacagctgaaacctccccgagccaaaccccggggaggttctccgtgttacgggatcatccatgaaaacagatgatgctgtaaaaatgtaatgagacagacgagcagaagcaaaaacagactgtgcttaatcgtaaagcggaaaaggtcggcttccttgcccgccagaccgacagcggcacaggcaaccgcaatggattgcggagaaatcatttttccggtgacaccgcctgatgaattggcggcaacggagagaaccgggtccatcccgacagatagcgccgtcaccttttgcaatccgccgaacaataggttggccgatgtatcagagccggtaataaatacgccgagccagccgagcaccggcgaaaaaaaggtaaacatcgcgcccgtcatggcaagcgcaagaccgagtgtcgtgctcatgccggaagcattcgtcacatatgcaaagccgacaacagaaacaatggtcacgaccggaagcgttaactctttcaccgtttctataaacgcttcgccccacgtcttccacgacatgccgagggcgaacttggagatgacggcggcaatcagaatcgccgttcccgctgaaccgaaaagctcaagtttgtacacggcttcaatcggcgtgccgtccgcctgaagaatctgctgatttacaaatgggacgggaggcgtgaaggtcaatgctttcccggctgcattcagccaggaaagccacattgacgttccttcataatgaccggttaaagcagccttcacgccgggaatcccccaaacggatatcatggccgtcagaagaaggaaaggagaccacgctttaaacaccgcggcgcccccgtacttgatcggcgcccggtcagcggccgctgctgattcccgttctgccgcgaaacgaaaggccgttttcggtttccaaaatttcaaaaatacagcgagcgcggccatggaaacaagcgccgacagcacatccggaagctcaggccctaaaaaattcgagcttgcgtactgcacggccgcaaaggagacgccggaaacaagaatggccggccatacttcaaaagcctttttaaacccgctcatcaaaatgattaagtaaagcggaataaagacggataaaaaaggaagctgccggccgaccatttgggaaatttccattgccggtatcccggtcggaccttcgacggcggtaatcggaatgccgatcgcaccgaaggcaacgggcgccgtattggcaatcaggcaaattcccgccgcatacagcggctgaaaaccaagtccgacgagcaaagcggccgagatcgcgacgggagcgccgaaaccggcggcgccttctaaaaatgccccgaatgaaaaggcgatgagcagcgcctgcaaacgccggtcatctgtaattgagagcaccgaactccggataatctcaaactgtcccgttttcacggtgattttatacagaaagaccgatgtgacgataatccagccgatcggaagcagcccgtacaccgctccctgagaagcggacatcaccgctttttccgccggcatgccgtaaacaaatacagcgattaaaagtgaaacggctaacgttaaaagccccgctatgtaccccttcatccgtttcaccgcaagcgcccaaaaaaagaagataatcggcacgagcgcgcaagctgccgataaaagcaaatttccccctaaaggagcgtacccctgtgtccattgcatccctaaaaaacccctccttatgtcatgtaaacgattactttttatgataaggtcatctgatgaccgggttaattagcattatattttgaaagttttgaaagtacaatacttttcttgaacaaattgtctgaacctgtcggctacacaaaaaaagaagtataatagacgataaacatcaagattcacaagtgacggggtgatcgcgttgaaatataaacaaattaaaacgaaaaaaatctacgaggaagtcgctgacgcattgctggagaagataaaagcgggcgagcttaagccgggggaaaagcttgattctgttcaggcgctttccgagagttttcaggtcagccgctcggcggtcagagaagcgctgtcggctttgaaagcgatggggctcgtcgacatgaagcagggagaaggcacatacataagagaatttgagccgtctcatgtttcccagccgctttcttccgccctcttgatgaaaaaagaggacgtcaaacagctgctcgaagtcagaaagctgcttgaactcggcgtcgccgccatggccgctgaaaaacgcaccgaagacgatttacaaaaaatccgccaagctctcatggagatgaaagacattgacggagacgaagaattgggcgaaaaagcagatttctcctttcacatggcgctggcggaagcatcacaaaacgggctgcttaagcatctcatgaatcatgtctccgcgctccttttggaaacaatgagagaaacgagaaaaatttggctgttttctaaacgaacgagcgtgcagcgattgtatgaagagcatgaacgcatttacagcgccgtcgccgccggagacacggatgaagcggaagcagcgatgacggcgcacctgacgaatgtggaagaagtgctgggggcttattttgaagaaaatgtatagaagctgacttgtgaaaggggataacatcacatgcaggccgaatcttttttttctgaccatgtaaagaaagctctgacaaatgatcctcccggggaatggatgccggcagttccgaaagcgtgcatccctctgcattccggctatcccgatcccgcgctcgttcctgataaggagctgaaagaagccgcctcccgccttctggatgaggagcgtgatctgccgctgcattatataggaagcccgaggacggccgttttaaaaaagcagattcaagaacggttagccatccgcggcattcactgccgggacgatgagctgatcgtgacatcaggcgcctgtcaggcgatagatctggctgcgcgggttttcctcgatgaacaaaccgccgctgccgttgaagctccggtctatatggaagcgctcgagatttttaaaaattatacaccgcatatcatgagcattccgacagatcaagagggtctgcaaacagaaacattagcgtttatgcttgaggaaagaaaacgaaaagggcttgtgcttccccgtcttctctacacgatacccgcttttcagaatccggcgggaaccgtaatgtcatcgaagcggagaacccgcctgcttcagcttgccgaaacgtatgattttctcatcttggaggatgatgcatacggcgagctcggattcaccgatattccgccgcccttgaaagccatggatcaaaacggccgggtgctgtacgccggttcattatcaaaagtcatcgccccgggtatgaggatcggctggattgcaggggacgccgcattcatcacggcattgtcatggttaaaaaaagacttaggccatccgttttcccaagcggtgaccgccgtctatctggaacaaacgaatattgaagaacggctcgccgccttgcgggaagcatatcgaagcaaacgtgatgttttgctcgccgcatcagcgcgatatcttccggaatccgcatcctggcacgtgcctgaaggcggttactttgtatgggtgaaagcgccgggggctgatacgtccgcactgctggcgagggctctgtctcacggcgtttcctatgtacccggaaaatatttttttccgcatcaggaagacggtgccgaatatctccgcctgtcgttcagttttcccggtaaagccgcgataaaagagggtgtgcaaaaactgggacacctgctgaaaaacgggatctagagaagcatgggaagctttcaggcttctcttttttttacccttcagcgcatcgggcgaaaggatttttcagaaaaaccttccaatccatattcagaatagtgtaggatatttatagagctttccaaaaacaggtcatcagatgaccggatcacatactgaggatgaaagaggggttcatcatgaaagtctcattatttgtcacgtgccttgtggatatgtttcagaccaatgtcggaaaggcgacggttgaggtgctggaacggctcgggtgtgaggtggattttcccgaggggcagatttgctgcgggcagcccgcatacaacagcgggtatgtgacggatgcgaaaaaagcaatgaagcggatgattgccgcgtttgaagaagcggagtacgtcgtcagcccgtcaggttcctgtacgacgatgttccgtgaatatccgcatctgtttcaggacgatccgaagtgggccgcaaaagcgcagcagcttgcggacaaaacatatgagttaacggattttatcgtcaacgttctcggggtggaggatgtcggggcggtgctgcataaaaaagcgacagtccatacatcgtgccacatgacgaggctgctcggcgtgtcggaggagccgatgaagcttttgcgccatgtcaaggggctcgagctgaccgcgcttcccggaaaacaccaatgctgcggattcggaggaacattttctgtgaaaatggcgcaaatctctgaacaaatggtggatgaaaaggtcgcctgcgtggaagacacggaggccgaggtgctgatcggggcggattgcggatgtctgatgaatatcggcgggcgtcttgaccgtaaggataaaaacgtcagagtcatgcacatcgcagaagtgctgaacagcagataagacgagaaacaacaagggggtaaaatcatggcgatgaaaatcggtaccgccgcttttaaagagcgggtatcagaaggaatagataatgagtttatgagaggagccgtctccggagcgcaggaacggctcaggataaggaggcttcaggcggccgaggaattgggaaactgggaggattggcgttcacatgcggaagaaatcagacagcatgtgctggacaatcttgatttctatttggaacagctcgccgaaaacgtcgccaacagaggcgggcatgtctttttcgccgaaacggcggaagaagcgtcctcctatatccgcgatgtcatccggcagaaaaacgccaaaaaaatcgtaaaatccaaatccatggtgacagaagaaatcaatatgaacgaagtgcttgaggaagagggctgtgaagtcacagaaacggatctcggcgaatacattctccagattgacgatcacgatccgccgtcacatatcgttgctcccgctcttcacaaaaacaaagagcagatccgtgacgtgtttaaagagagactcgaatacaaacagacggaaaaaccggaagagctcgtcatgcacgcgcgcagcgttctccggaaaaaatttctcgaagcggatgtcggcatcacgggctgcaactttgcaatcgcggataccggatcggtcagtctcgtgacaaacgaaggaaacggccgccttgtgtccgcgctgccgaagacgcagatcaccgtgatgggaatggagcggatcgttccttcattttctgagtttgaagtgcttgtcagcatgctgacgagaagcgcggtcggccagcggcttacaagttacattacggcgctgacgggcccccggcagcaaggagaagctgacgggcctgaggaatttcatctcgtggttgtggataacgggcgttcccgcatactcggcacggaattccaatcggtgctgcaatgtatccgctgcgccgcctgcatcaacgtctgtcccgtgtaccggcatgtcggcggacactcgtacgggtccatctattcgggtccgatcggcgccgtcttatcgcctcttctcggcggatatgacgaatacaaggagctcccgtacgcatcttccttatgcgcggcctgtacggaagcgtgtccggttaaaattccgctgcacgagctgctgctcaagcatcggcagaacattgtggaaaaagagggcaaagcgccgatcagcgaaaaactggcgatgaaagccttcgggctcggctcgtcatccccgtccctttataaactgggatcgaaatgggcgcctgccgccatgacgccgtttacggaggatgacaaaatatcaaaagggccggggccgttaaaagaatggacggcaatacgggacttcccggcgccgcataaatcgagattcagagattggtttaaagaccgggaaaaacaaaagggggaagaatgatgatgaaagggacggttacacatcaggaatcctttctaaaccggatcgccggaagtctgggcagagagcgcaggaaatcaggcgtgtccctgcctgaatggaagtatcagcctcaatatcaaacgcatgcggactgtacggaagacgatcttgtcacgatgctgaaagaccactgcgtcaacattcataccgaactgatcgaaacggatgcagccgggctttacgacgctttgcgcacgcaggtgaaccgctttgaagggggcctgtcatcattccgaacgacagccggtttgaaatgtacggcttgcagacccttatgacagaagagtggccggacgaagggattcccgtttgggaatgggacgcggaacaaggagcgaaaaatattgaaaaagcggaacaagcgaatgtgggcatcacattcagcgagatcacgcttgcggaatcagccaccgtcgttttgtatgcgtcagagcatgccggccgttccgtcagcctgcttccgaccacctatatcgcaatcatcccgaaatcttccattgtgccgagaatgacacaggccagcgatatactgaaacagcagatcagagacggcgtcaccgttccttcctgcatcaactatattaccggaccgagcaactcggccgatatcgaaatggatttggttgtcggcgtccacggacccgttaaagccgcttatatcctcgtgaatgaccgataaaaaaacaaaccccggtttgcggccggggtttgtttttatataaacgcgttaatgatcatgataaaacagatcgcactgacagaaataatcgtttccatcgccgtccatgtcaggaacgtttcttttaccgtcattccgaaatactctttaatgagccagaaaccggagtcattgacatgtgacagaatcaaagagcccgctcccgttgccaaaacgagaagctcgctgctgacgcccggcatgacagatgcaatcggagcaacaatgccggccgccgtcatcatggcgacagtcgctgaacctgtggcgacacggatgaccgccgcgatcgtccagcttaaaagaacgggagagaagcttgagtgcttcgccatgtcagcgatatacgtgccgacgcctgaatcaatcaggacgttgttaaaagcgccgccggctccgatcacaagcagaatggaagcgatcggtcccagacagtcattgctgaattttaaaatgctttccctgtcaaagccctgataaaaaccaaggctgaaaaaggagtaaaccgtggcgatcaaaagcgccgtgacagggtcgccgataaatttaaaagtttcatagagcgtgcttttttccggaagcgcaatttcggcaagcgttgccataagcatcaggatcaccggtaccaatatcgtaaacaatgtatttgcgaatcccggaagcttgcgtttttcattccgttcaataaattgttttttcaacagttcgggaacgggtttatgaatgcgcttaccaatccattttccgtaaagcggccccgcgatgatggcagtcggaataccgacgattaaagaatacaaaatcgtttttccgacattggcgtgataaatgccgacagccgccatcgccgccgggtggggcggaaccaatccgtgcacgacggaaagtcccgcaaggagcggaatcccgatcgtcactaatgaaaccccggtttcaatcgcaatcgtaaacaaaagcggcacgagcaggacgaagccgacctggaaaaagaccgggatgccgacaataaaagcgacggccatcatcgcccaatgcactttctttttgccgaagcggccgatcagggtgtgggcgatccgctccgcaccgcctgattcagccatcatttttccgagcatcgtaccgagggccagcacgatcgcaagcagagacagcgtattgccgagcccggttttcattgaagtgataatgtccggcagattcatgcccgttgcgaaaccgacaaggatggatgtaatcaaaagactgataaacggatttaatttagcgaccgtaatcaataagagtaaaacgataatagcggcaatgacaataaacagtaacatgaccttttcaccctttctttcaaagaagaattaacggctttgtttgagctgaaattcactgatgacgtcaaattcatctttgagcttgtcatacagccgctcgtataagtaaaacagctcaatatatgtttcgctgtttttgacgttcggttcatggcggtgcgaaattctgatccagtcctgaacatcctcgatccgttccatttcgccaaggctgtgcaaagcgagaacggccgctccgagcgcagaggcttcgtaactttccggaacgaggacttcgcgtcccatcgtatcggacaaaatctgcctccacagcggcgatctcgcaaatcctcccgaagcccgcacgtcttttgcggggcccgccaaatctctcagtgcgacaccgattgaaaagacgctcatgatgacgccttccagcaccgctctgataaaatgctcccgtttatggcggaggctgatgccgaaaaacgttccgcgggcattcgggttccaaaacggcgcgcgctcccctgataaaaacggcagaaacagcaatccctcagagcctgcgggcactttatcagcaatatcaatcattaaatcgtacggatcaatgccgagccgcttcgccgtttcaacttccggagaagcgaattcgtctcgaagccagcgcagcataatgcctccgttattcgtcgggcctccgatgacccaatgcttgtcagtcagcgcgtaacagaatgtccgcgctttttcatccgtaatcggcgcatccgtcaccgaacgcacggctccgcttgttccgatcgtaacggccacttcgcctttgccgatcgcgccgactcccaggttggcgagcacgccgtcatttgcgccgataataaacggtgtatccgcatggatgcccatccgtgcagcgatttccggcgcaaggccgcgcagctgatgagtggtcggcacaatgtccgacagctgatcttcccggattccggcaatcctgagcgcttcttcatcccaggaaagcgtatctaatcggaacagtcccgttgccgaagcgatcgaataatcgacgacataagttccgaaaaactcgtgcagaatatattctttaatactgatgaatttggcggttttcgcgaatgtctccttgtcctgttctttcatccacacaattttggaaagcggagacatcggatgaatcggcgtacccgttcttttataaatatcaaaaccgttcatctcttttaaaatccgttttgattgctcggcgctgcggttgtccgcccaaatgatgcttttggtcagcaggccgccgttttgatcgacagctatcaatgagtgcatggcggtgctgatgccgattgcaagcagattgtcaggactcagtccggcctttgtgacggcgcccctgatgcttccgatcaccgcttccaaaatgtgctcaggatcctgctcggcccatgccggctttggctgtattaaatcatagtgaaccgaatgcttggctaacactttgcctcttggtccgaacagaacagctttcgtactggtcgtgccgatatccagaccgataacagcttgggtttccttcataatatatcccgcctaatctgattgaataataagatagatttataatgtatgcccttacaaagtcaattataggaataatttttttataaatcaacgatgaagaagaaaaattttttcataaaattgcctcaattcccgctgtatcggctttctctcttttgaaaaaaatatttagaaaacgattacaaacgtttgtgcgcgatcatttttctgatttgctgcaagttggcgagcgttttctcctgccgcagccgggccgtggcgaaatacagtgtatcaatgaccgacagctgggcaagccttgcggacatcgcctccgttctgaaagccgtctcccttgttgatgtatacagcacaacgtcggaaatctgggtgagcggcgacttttggtagcttgtaatgccgatcgtgccggcgccgagcgatttggccgttttgaccgcgtcgagcacgtccttgttgctccccgaatgagaaatgccgatgactgcgctttcaggaccgagaagacccgctgacatcgcctgaaagtgagaatccgtatgcgcgatgcaatttatacccgtacgcataaatttatgatacgcgtcagtggcgatcagcccggaaccgccgtttccgtaaaattcgattctgtctgcgcggtggatcatttctaccgctttttcaacgtcggccggatctaataattgaaaggtatcggtcagaccggaaatgtttgtgcggaaaactttccggatgatgacttcgatatcgtcgtcggggctcatttcttcatgaatgtgctgcaccggctcctgaacgatctcctgagccagcgcgatttttaaatcctgatagccggaaaaaccgagccgcttgcacagcctgaaaatcgtcgcttcagagcttttcgttttttcggccagctgaatgatggaaaggtgaaccacgtctttcggttccttcacgatatggtctgcaatcgctctcaattttggcgacaaacctttgctggccgcctgaatcttcccgatgctgcttgaattcacaggggtcatactataacctccctactcgaatgtaaacgcatacttttatgataaagcaagtttcaatataaggaaaacagaattttaaaattgttttttcaattttgtgtgtaaaaaaagagaaaaagccgccgatgatagaaagtgaggaggcatctgaatgaaaaaagcatggattctcgtcatatcattcggcattgcgcttgcgctgtttttatacgcaaacacaaaggtgaaagcggaaagcatggcgccggaaagcaaagccttgtgtccggatttcagctgaaatttccgaatcaccgggaaggacaatagacggaaaaaattagtattgactttgaaaatagaagactgtatattatgttactatattcagaaaataaaaactcaagagattcatttaacataaaacactgtgaacgggagcagtaagagaatccagtcagaaaaagagagccgcgggttggtgaaacgcggactgattgttctttgaactcgcccggaagtggcagggcggaacggaattgtcggaatattccctatgtcctaacggctgaccttcgttaaaaggtttttaagctggattccggatattcgggatcaacaagagtggtaccgcggctgcctgaggcacgccgtctcttttcctaaagaggcggcgtgcttttttatgtgatgaacactttttgcgagagggcgtgtgatagatggaaaaggacaagcaaacgttaaaacggacgatgtcgtccagacacattatgatgatggcgcttggaggcgcaatcggggccgggctctttaaaggcagcagcacggcgattgatgaagcggggccgtccgtgctgttggcctacctcctcggcggaatcattctgctgtttattatgcaggggctggccgaaatggccgtcagaaacaaacatgcaaggacgttccgtgatttggttcagcagtctctcggttcgtacgctgcatactttttagactggatctattggaaaatgtgggtgctcaatattgccgcggaggcggtcgtagccgccattttcattcaatattggctgccggaatgtccgatatggatactggctttgatcatttccatcgtggtgacggtcgtaaacatgctttctgtgaaactgtttgccgagacggagtactggctcgcgctcattaaaattacggtgattgtcatctttattttatgcggaattctgctattatttttctcattcggcaatcacacggcgccggggctgtctcatttaacggatcacggagggtttttcccgcatggagcggggggcgtcattacggcgatgctcgtcgtgatctactcatacggcggaacggaaatcatcggcgtcacgctggcggagacaaaaaaccccgaaaaggtgattccgaaagctgtccgaagcacgttaacgcggattgtcgctttttacttgctgccgtttttcatcatcgtcagcctgattccttggaatcaagtcaacagcgttcccgaaagcccgtttgtcatagtatttaagatgatcggaattccgggtgccgaccatattatgaatgccgtcattcttcttgcgattatctcgtctatgaactcgggactgtacggatcatcccgcgtcttatttacgcaggcttctgacggccgggtgccgaaaatcttttcaaaactatcgaagaaaaaggttcctgtctatgcgattctgacttgtacgtcatttttatatgtaggcgtcctgatttctttattcgcaggaagccggacgtttaattatttgatgggttccctcggctataccgtgctgttcatctggctgattatcggattcgcccatttaaaatcaagaaaacattcaacagaacagccggcttattacgtcaaatggttcccgtacacgacatggttcgcggtgcttgcgcttttggccatcctgatcggcgtaattgcgacgacgtccatcgtcatcacatgcatcactgcggccatctacctgctcattacggctgcgtatctcgtgaaagggagacgtcaataaataaaaaaactcttgccccgcggcaagagtttttttaatgaacggcctttttttctgcggccagagcaggtgttttcagtttcttcggtgttatattcacaaaacaaatgcttgtgacgatcagaagcagtccggctaaaaggctgacggtcagcggctcatgcagaaatatcgagctgacgacaatggatatgagcgggatcaggaaggtgtaagaggcaaccttgcttgcttcccctgaaccgacaagcgtaaaaaaggcgagccagccgagtgcgatgacaaataccgaaatgaacagaaggctgagaatgaacggagttttccattgaatcgctgaaaagctttctgaaaaatggccggagctgacaagcagcacgccgccgatcagaagctgaagagcgaccatccagatagagtccgcgcgtccgcccgttcttttcacatataccgtgccgagcgcccagctgaccgcggagcccagagccaaaagaatgccggcgatggaaatatggcctccgaaaccggctgcgctgatgacggcgacaccggcaaagcccagaataagaccggctatttttaaaggatacatcgattccccgagccacagccaagaaaaaacgcccattaacaccggctggaaaaacacgatggctgaaaataagccggcatgcaggtaattcaagccgaccgtttgcaggccgtaaaataaagtaatatttaaaatggcagaaataagatagatcggccacgtttctttaaaacgcagctttttaaaacggggcagcgccaccattaataatagaagtccgccgatcagcgtgcggattccggcaaacagaagaggcggcgaataggcgagcgcggcttttgtcagcggccagttaattccccataccgtgactagaaacgccagcataagagccgtctgtattttcgaaagctgtttcacgtcgttcactccttgtagaacaattccatcatatgatacggtaatcagtaagataaataaaatgaatcttttttataaggagcataagtaaaacgttatgacgattacacaactgcgggtttttgttcaaatcgctgaaacgggaagctttacaaaagcggggcaggcgctgaatatgacacagcccgccgtaagccatgccatctcggcgcttgagtcagagctcggcatcaagctgatcatccgcgagcgccgcaacggcgtaaggctcacggacacgggcggaaaaattctcgttcatatcagagaggtgctcaaaggcatagaaaaagccgagcagctggcggccgcggaaagagggcttgaacagggaacgattcacatcggcacatttccggccgcttccgcttatttcattccaaaactgatcagcgtgtttaaaaaacggtatccgaaacttgagttggtgctttatgaaggaacggttaacgaagtaaaggaatggctccgctcccgggtaatagatgtggggatcactctttttcctacggaagacatggaatatctgccgctgaaaaaagataaaatggccgtcgtgcttagaaatgatcatccgctttgcagctgtgagtcaattactctgaaagatcttgaccgccagccgatgatcatctgtgacggaggatacgaatcaccgtttattgatatgtttaaggaggcagggtctgtgctgactgccgcattcactgtttacaacgtcaatacgtccatcagcatgatcaaagaggggctgggaattgcgatattatcacaaatgtctatgtccggaatatcactgccggaaaatgtcgtgacaagggaactcaatcaggcggtgtaccgtgatgttctgcttgccgttccttctgtaaaagaggcttcattggcggcaaaactttttattcaaatcgcgcaggagctcacaaagaatgaataaaaaggccctaatgatcttagggccctgaatcttatcggttaattttaaaagagtttgtcgtattgacaagttttgaaccgctgaacgtagctttgacacgataataacctgtcttgcatccttttaaagagaatgacttagtcacccttactgagaaagaaaaggttgtttttttgcaagtcgtccatttctttccggactttcgctgtaagtataggtttcctttaaaggttcgatctgacggatacgctgtactgagagtaaaatcgacacttttcgcttttttcgtgtagtaggaggcatcggtaaatccgcttacatttaaatgctgctgagtgccggaataaaagtctgcggcatatgccttatcggtgtttccggtaaagaagattgctgccagtaaagctgttgtgagtgccattaagatttttttacgcatatagactatgacttccttcctattcaatatatgacatatgttaacattattggttctgttctttcaatgatatcttttcatttttatatcattctaggctcttcatatctgaatgtaatagattcattcatacagagttcactagtgacgaccgctgactgattgttcgaagatcatcgaatcaaattgtttaactcacgggaaaagctgtggtaaggtgtgtggtagagaccttgtttaagatctgcttacactaaaccataaaggagaaaacgatggctgaacatacattgaaagatactgcgttttccgtattgaatttatcgccggtcgtacaggggggaacggttgctgaatcgttccgcaacagcatggatttagcgcaccgcgccgaggagtggggctataaccgctattggctggcggagcatcataatatagaaggtgtcgccagctcggcaacggcggtgctgatcggccacatcgccggcggcacgaaaaaaatccgcgtcggttctgggggcattatgctgccgaatcattcgtcacttataatcgcggagcaattcggaacccttgaaacgttatatccggggcggattgacctcggactcgggcgtgcgccgggtaccgaccaattaacggcgagggccttaagaagaaacataaacagcggggaggatttcccggagcagcttgaagaattgagaaattacttcaaaccctcaggcaatgtgcgcaatcaagtccgcgccattccgggcgaagggctggacgtgccgatctggcttttgggatcgagcggcttcagcgcgcgtcttgcgggagagctcgggcttccgttcgcctttgcggctcacttctcaccgaaaaacaccgtgcccgcccttgagctgtaccgaagctccttccgtccgtcagacgtactggatcaaccgtacgcgatggtcggcgtcaccgtcattgccgccgatacggatgaaaaggcggagcatctggcgacatcgcattatcaaagatttttagacctcgtccgcggcacgccgaaccagctgaagcctcctgttgaagacatggatcaaatctggtcgccgtatgaaaaagcgatggtcaatgaacagctcagttcaacgatcgtcggcggaccggagcgtgtgaaggaaaagctggaaagcttcatccggacaacacaggcggatgaaatcatggtgaattcagaaagctttgagcatgccgacagaatgagatcatttgagatcatcgccgaattaaaaaacagctgagcaaaaaaagcaatgtgccgcgcacattgctttttttattcgccgatccgcctgacggaatttcggatgacgagttccggttcatacacgacgtcatccttcttcggttttttatgctctaagcagccgatgacgtattttgccgccgctttccccataatggatttcggatgcttgacagaggtgagcttcacctcggaaatctgggcgaaatgtgaatcatcatagcccatgattgacacgtcatcaggcacctttaagccgaattctctgagaagattaatcgtcttcagcgcaatttcatcattataacaaagaatggccgtcgggtatgatccgctgttttgctcaagggtatgcttaattttttgaagaagcacggtttctttttcttcagtcgtgtaagtcacgatcatgtccggagacggaaaaatcccgcgctcccggtgcgcctgaagatagccgttcatccgtttgacgccctgcgtgtcatccgctttaaagattcccataatgtgcgtgtggccgagggacatgacgtattcgcaagccatcatgccgcctttgacatcattgacggaaaagctcggtgcggccagctccgcataagaggcgttaatcatggcaaacggaatgccgtttttctccaggttgagatagtagccgatgttgggcgtctgcagcgcgcttttcgtaggctcgacaatcagcccgtctatatttttggacagcaggttttcaaggccccgccgctcactttctgtattgttgttggtgctcgtcagcagcatggaatagccctgttcgcttaaataagattcaattcccctgatgatgctcgggaaaatatagtctgatatgtacgttgtaatgacaccgatcgttttgtttgaatgcatggctgatttcgccgtgcgtgaagcgacaaaggtgcctccgccctgaacgctgtacagcaacccctgcgagaccaaatctccgatcgcctttctgatggtatggcggctgaccccgaactgctgcatcagctcattttccgtaggcagcttttcgtccggctgtatttttccctgattcagccatgaacaaatttcttcttttacttgagcatatttcggtagcatatcaattcctccaaaatgtatacggacaaattccagtataacatagtaagccctttcatcaagctgtaaaaataattgacagattgtgaaaaactgcttattctttatttgtacgtactaattttccttatttttagataaaattctttataagtacgtacaaatgtggcggttctgaagaaaacaaagcaactcaagcgccgcactttgttttgtaagcgtttttattctattattcgcgggagggtaaaattcatgaagaatcacccggcaccaattggctcaaatgtacctgtcactcggcagcattcgaagtggtttgtcattctcatctcatgcgcggccggactgggagggcttttgtacggttatgatacggcggtgatttccggcgccatcggtttcctgaaagatttgtaccgcttaagtccttttatggaagggctcgtgatttcaagtattatgatcggcggtgttttcggcgtcggaatttccggatttttaagtgaccggttcggacggagaaagatattgatggcagcggcgctgttgtttgcggtgtcagcggttgtctctgcgctttctcaaagtgtgtcttccttagtgatcgccagagtcatcggcggtctgggaatcggcatgggctcctcgctttctgtcacgtatattaccgaagccgctccgccggccatacgcggcagtctttcctcactgtatcagctgtttacgatattagggatctccggcacttattttattaaccttgccgtccagcagtccggctcgtatgaatgggggtgcacaccggctggcggtggatgctcgcttacggcatgattccgtccgtcatcttttttatcgtgctgcttatcgtgccggaaagtccgcgctggcttgcgaaagcggggcgccggaatgaagccctcaccgtgctgacgcgcattaatggcgagcagaccgcgaaagaagaaatcaaacaaatcgaaacgtctttacaattagaaaaaatgggttcattgtctcagctgtttaaaccggggctgagaaaagcgcttgtgatcgggattctgctggctttattcaatcaggtcatcggcatgaacgcaattacgtattacgggccggaaattttcaaaatgatgggcttcggacaaaatgcggggtttatcacgacatgcatcgtcggtgtcgttgaagtgattttcaccattatcgcggttcttttagtcgataaggtaggccggaaaaagctgatgggggtcggatctgcctttatggcgctgttcatgatcttaatcggggcatccttttattttcagctggcgagcggtccggctttagtcgtcatcatattgggattcgtcgccgctttctgcgtatcagtcgggccgattacgtggatcatgatttcggaaatctttccgaaccacctccgcgcacgcgccgccggtattgcgacgatattcttatgggggccaactgggcgatcggccagttcgtgccgatgatgatcagcgggttggggctcgcgtacaccttctggatattcgccgtcattaatattctctgtttcttgtttgtcgtgacgatctgccccgagacgaaaaataaatcattagaagaaatagaaaaactctggataaaatgaaagcgttttacggcaaaagtccgctgcggcgggcttttgtctgtcaccttcattccgtttctgtatataatgactgtatcaaggagatactggtaaatcctgcgaagaatgtcgaggaattgacctttaacagttgaattaacaatgtcatcctgttaaaataattaaagaaagcagacataattttttttggctatgatgggacgttttttgtcatagcgggacattttctgtccagtatgaataggaaggaacgtttgagtcatgaaccagttaatacaagctcaaaaaaaattattgcctgatcttttgcttgtgatgcagaaaagatttgaaatcttgcagtatatcaggcttacagaaccgatcggccgcagaagtcttgcagccagtctcggattgaccgagcgcgttctcagaagcgaggttcagttcttaaaagaacaaaatctcatcgatattaaaacaaacggcatgacaatgacggaagagggctattcactgctttcgattctggaagatacgatgaaggatgttttaggattgacgcttttggaaaagacattaaaagagcggctcaatctgaaagacgccattatcgtttccggagacagcgaccaatctccttgggtcaaaaaagaattagggagagcggccgttgcatgtatgaaaaagagattttcaggcaaaaatatcgtcgctgtaaccggcggtacgacaattgaagccgtcgccgatatgatgacgccggattcaaaaaaccgcgagctcctgtttgtgcccgcaagaggcggtttaggcgaagatgtgaaaaaccaggcgaacaccatatgcgcgcatatggcggaaaaggcttcaggcacttaccggcttttgttcgttcccggccagctgtcacaaggcgcctactcatctattattgaagagccttccgtaaaagaggtgcttcacacgattaaatcagcgagtatgctcgttcacggaatcggcgaagctagaacaatggcggagcgaagaaacacgcctttggaagatttgaagaaaatagatgacaatcatgcggtgacagaggcattcggctactactttaatgcggacggagaagtcgttcacaaggtgcattcagtcggaatgcagctcgatgacctcgatgccattcccgacattatcgcggtagcgggcggatcatcaaaagcagaagcaatcgaagcttattttaaaaagcagcgaaacacggttctcgtcacggacgaaggagccgcaaagaagttattaagggataacagtccctcaatataaatatctctcacttatttaaaggaggaaataatcatggcagtaaaagtcggtattaacggttttggtcgtattggacgtaacgtattccgcgcagcattaaacaatcctgaagttgaggtagtagcagttaacgatttaacagacgctaacatgcttgctcatcttttacaatatgattccgtacacggaaaattagatgcagaagttaaagttgacggcagcaaccttgttgttaacggcaaaacaatcgaagtttctgctgagcgcgatcctgcgaaactcagctggggcaaacaaggcgttgaaatcgtagttgaatctactggtttcttcacaaaacgcgcagacgctgcgaaacacttagaagcaggcgcgaaaaaagttatcatctctgcacctgctaacgaagaagatatcacaatcgttatgggtgttaacgaagacaaatacgatgcggctaaccaccatgttatctctaacgcatcttgcacaacaaactgccttgcgccgtttgcaaaagtacttaacgacaaattcggcatcaaacgcggtatgatgacaactgttcactcttacacaaacgatcagcaaattcttgatcttccgcacaaagactaccgtcgtgcgcgtgcagcagctgaaaacatcattcctacatcaactggtgctgctaaagcagtttcccttgttcttcctgaactgaaaggcaaactgaacggcggagctatgcgtgtgccgactccaaacgtttctcttgttgacctagttgctgaacttaacaaagacgtaacggctgaagacgtaaacgcagctcttaaagaagcggctgaaggcgatcttaaaggaatcctcggctacagcgaagagccattagtatccggagactacaacggcaatgctaactcttctacaatcgatgctctttctacaatggttatggaaggcagcatggtaaaagtaatctcttggtacgataacgaaagcggctactctaaccgcgttgttgaccttgcagcttacatcgcaaaacaaggtctttaattcatagctcccggaaagggccggacttggttctttcggacagaaacgctataatgaaagcggacaagggaaggggacggactccctttccctttttccatgagaaccggctttcagaaagcgccggattgctgcagaacgtccgcgttttgaagtttccgcggcactttcgttttctgagccgcctgccctggctcagaagacgatctgccccgtgcccggaagctgcaatctgccccgcggcggaagcatcatgaggcggtttcacgtttcacgtttttcgtgctatgcaaaccattttgaaggaggatctcctaaggcatgaataaaaaaacagtaaaagacatcgacgtaaaaggcaaagtcgtattctgccgcgttgactttaacgttccaatgaaagacggggaagtaacagacgatactcgtatccgagctgcgcttccaacaatcaaacaccttgcagaccaaggcgcgaaagtccttcttgcgagccacttaggccgcccgaaaggcgaagtggttgaggagcttcgtttaactcctgtcgctgcacgcttaggcgaactgctcggaaaagaagtgaaaaaagcggatgaagcttacggcgatgctgtaaaagcacaaatttctgatatgaaggacggagacgttcttgtattggaaaacgtacgtttctaccctggtgaagagaaaaacgatcctgagcttgctaaagcatttgctgagcttgcggatgtatatgtcaatgacgcattcggtgctgcccaccgtgctcacgcatctacagccggaattgccgagcatctgccggcggttgcaggattcctgatggaaaaagagcttgacgttctcggcaaagccgtgacaaatcctgagcgcccgtttacggcaatcatcggcggcgcgaaagtaaaagacaaaatcggcgtaatcgaaagtctgcttgataaagtggacaacctgatcatcggcggaggtcttgcttacacattcgtaaaagcgcttggctatgaagtcggtaaatctcttcttgaagaagataaaatcgaacttgcaaaatcattcatggaccgcgcgaaagaaaaaggcgttaaattctatatgccggaagacgttctcgttgctgatgatttctctaacgatgcaaacgttcaaatcgtgccgatctctgagatcccaagtgatttagaagcgatcgacatcggaacgaaaacccgcgaaacgtacgctgaagttatcaaaaacagcaaacttgtcgtatggaacggacctatgggcgtattcgaaatcgacttgttcgctcaaggcacaaaagcagtggctgaagcattggcagaggcaaacgatacatactctgtcatcggcggaggagactctgcggcagccgttgaaaaattcggccttgctgacaaaatgagccatatctcaacaggcggcggcgcatcccttgaattcatggaaggcaaagagcttccgggtgtagctgcgctgaacgataaataaaaactgctataaggaagtggaacagatgagaaaaccaattatagccggtaactggaaaatgaacaaaacactcggcgaagctgtcagcttcgttgaagaagtgaaatcttccattccagcagcagacaaagcggaagccgttgtttgcgcaccagctcttttcttagaaaagctgacttctgctgttaaaggaactgacctgaaagtcggcgcccaaaacatgcattttgaagaaaacggtgcgttcacaggtgaaatcagcccggtcgctctgaaagaccttggcgtggattactgcgtcatcggccactctgagcgccgtgaaatgttcgctgaaactgatgaaacagttaacaaaaaagcgcatgccgctttcaaacacggcattgtgccgatcatttgcgtaggtgaaacgcttgaagagcgcgaagccggaaaaacaaatgatcttgttgccgatcaagtgaaaaaagggcttgcgggtctttctgaagagcaagttgctgcttccgttattgcgtacgagccaatctgggcaatcggaacaggcaaatcttctacagcgaaagatgcaaacgacgtctgcgcgcatatccgtaaagtcgttgctgaaagcttcagtcaggaaactgctgacaagctccgcattcaatacggcggcagcgtaaaacctgcaaatattaaagaatatatggcagagtccgatattgacggtgctttggtcggcggcgcaagccttgaaccgcagtcattcgttcaattattggaggaaggtcaatatgagtaaaaaaccagctgcactcatcattcttgatgggttcggattacgcaatgaaacagtcggaaacgcagtcgcacaagcgaaaaaaccgaatttcgaccgttattggaaccaataccctcatcagacgctgacggcatcaggcgaagcagtcggactgcctgaaggacagatggggaactctgaagtcggtcatttaaatatcggcgccggacgtattgtgtaccaaagcttaacacgcgtgaacgttgccatccgcgaaggcgaattcgaacgcaatcaaacgttccttgacgccatcaaaaacgcgaaagacaacgacaaagcgctgcacctgttcggccttctttctgacggaggcgtacacagtcacatcaatcatttattcgcgctgctgaaacttgcgaaaagtgaaggactgacgaaggtgtatattcacggtttcctcgacggccgcgatgtaggtccgcaaacggcgaaaacttacattcagcagctgaatgagcagatcgaagaaatcggtgtcggcgaaatcgccagcatttccggacgctactactccatggaccgcgacaaacgctgggaccgtgtggaaaaagcgtaccgcgcaatggcttacggcgaaggcccgtcttaccgcagcgcgatggatgtagtcgacgattcttatgcgaacggcattcatgatgaattcgtcattccgtccgtcatcacaaaagaaaacggtgaacccattgcgaaaattcatgacggcgattctgtgattttctataatttcagaccagaccgcgccatccagatttcaaacacgtttaccaacaaagatttccgcgatttcgaccgcggtgaaaatcatccgaaaaacctgtatttcgtctgcctgactcacttcagtgaatctgttgacggatatgtggcttttaaaccggtaaaccttgacaatacggtcggtgaagtattagcacagcacgggttaaaacagcttcgcattgcagaaactgaaaagtatccgcacgttacgttctttatgagcggcggccgcgaagaagaattcccgggcgaagagcgcatcctcattaactcgccgaaggtcgcgacatatgacctgaagcctgaaatgagcgcgtatgaagtgaaggatgctcttgtaaaagaaatcgcggctgacaagcacgacgcgatcatcctgaactttgcaaaccctgacatggtcggccactccggaatggtcgaaccgacgattaaagcaattgaagcagtggacgaatgcttaggcgaagtggttgacgccattatcgctaaaggcggtcatgccatcattaccgctgatcacggtaatgcggacattctgattacagaaacaggcgaaccgcacactgcccatacgacaaacccagtccctgtcattgtgacgaaagaaggcgtgacgctgcgcgaaggcggaatcctaggcgacctcgcaccaacgttattagaccttctcggtgttgaaaaaccgaaagaaatgaccggaacatctttaattcaaaaataagcgtaaatcaaaaggagagacaaactcatgccatacattgttgatgtttatgcacgcgaagtccttgactcccgcggcaacccgacagttgaagttgaagtatatacagaaacaggagctttcggccgcgcattagtgccaagcggagcttctacaggtgaatacgaagcggttgagcttcgtgacggcgacaaagaccgttaccttggaaaaggcgtgttaactgctgttaacaacgtaaacgaaatcattgctccagagcttctcggctttgacgtaactgaacaaaacgcaatcgatcagcttttaatcgagcttgacggtactgaaaacaaaggcaaactcggtgcgaacgcaatccttggcgtatctatggcttgtgcgcgcgcagctgctgatttcttacagattcctctttaccaataccttggaggattcaactcaaaaacgcttcctgtaccgatgatgaacatcgtaaacggcggagagcatgctgacaacaacgtagacattcaagaattcatgattatgcctgtaggcgcgcctaacttccgtgaagcgcttcgcatgggcgctcaaatcttccacagcctgaaatcagttctttctgctaaaggaatgaacacagctgtaggtgacgaaggcggattcgctccgaaccttggttctaacgaagaagcgcttcaaacaatcgttgaagcaatcgaaaaagccggcttcaaacctggcgaagaagtgaagcttgctatggatgctgcatcttctgagttctacaacaaagaagacggtaaataccatctgtctggcgaaggcgttgtgaaaacatctgctgaaatggttgactggtacgaagaaatggtttctaaatacccaatcatctctatcgaagacggacttgacgagaacgactgggaaggccacaaacttcttacagagcgtcttggcaaaaaagttcagcttgtcggtgacgaccttttcgttacaaacacgaaaaagcttgctgaaggtatcaaaaacggcgtaggcaactctatcctgatcaaagtaaaccaaatcggtacattgactgaaacattcgatgcgatcgaaatggcgaaacgcgcaggctacactgccgttatctctcaccgttccggtgaaactgaagacagcacaatcgctgacatcgctgtggcaactaatgcaggacaaatcaaaacaggtgctccgtcccgtacggaccgtgttgcgaaatacaaccagcttcttcgcatcgaagatcagttggctgaaactgctcaatatcacggtatcaactctttctataacttaaataagtaatgtaatggacgccgggagaatatctcccggcgtttttttatggtcccgggcttttccctcctttttcatcatcttcatttggtcaataatattcatttttcccctttttaaaggaatcagtgttcttcaatcgaaagggaagaggtgttaataagaggagggattatgatgaaattttcatttatgtcagccgcggtggcagcaagcgtcatatggggcgcgtctgccgggccgctgtccgaaactcatgcttattcaactgtgaccgcgccggtttttgatgctgatgaggcattggacactatgcatgatctgagtgaaaccatcggtccgcgggaaaccggaactgcgaaagaaaaggaagcggctgaatacatatcgaatcgtctgcgggctcagggcgccagtgtcaaagtacagtcatttccattgaaaaagtacttttcaggttcagtcacagcgggagatcatgaattcccgctccgctccgctgatcaatccgctgttgaaaaagagctcaaaatagaaggcgggatttttgacggcggctgcggatcacgcaatgacgtaacaggagccgaaggaaagattgcagtgatacgcgaaggaaagatccctgtttctcaaaagatcaaacatgccgaacaagcgggagccaaagcagtcattatttataatcagacaacaaaaccgctcgccgtccgtccgcataccgataaaggaatcacgataccggcggcgggtatgaaaaaagaagacggtgaagcattgcttcaggaaaagaaggcagtcattcaatttaaaaactataaaaaccgcacctcacaaaatattataggaacgcgcaaagcggcacaggccaactcttctgatgctgatattatttatgtcacagcgcattatgacagcgtaaaaggcgcgcccggagcggatgataacgcctcaggcacatctgccgttctggaaatcagcaagcaactcaaacatataccgaaagacaaagagatccgctttatcctgttcggtgcagaagaattatggtctgcgggttcatcttattacgtcagtacactcacgaacaatgaaagaaagcacagccgggccaattttaatgccgatatgattgcgactgactgggaagaagcgagtcaaatgtgtgtcacgactcctgacggcaggaaaaacccgagtgtccggtatgctgaaaaagccgctgaaaaatcccggttggtcaagccaaacctgattcagctcggttactcagaccatgtctctttttatgaagcggggattccgtcggctaactggatttggctcagccccgatacacaggagccggggccctggtaccacaccgaaaatgataatatgaaacacatcagcaaagaacggctagagaaagctggagcactcgtttccgcggcagtaactgaggcaatgaaggaataaaaaacaggcttcggcctgtttttttatattattttctgtatattctatcaattaagggagattttctcactcgttaccagatatataccatttaacaggattttattttacaaataaaagaaaaataaatagataatacctaattcacaaaaggatgtaaaactcatttatcaaattttaacttttgttataattgcgatatcgatcgatatttgttttaaattgtaaaaaacaatactcttttctatctattagggggcgaaaaatgaatactgtcacaaaagaagccagcaaccttggtcaaaaacggctgttacatctgattgaaacgaagcaggcgatagtaggcgtgttaggcatgggatatgtgggatttcctcttgcgctggaatgtgtcgataaaggatacaatgtgatcggatttgacaaaaacagtgaaaaggtttccttgttagccgccggaagcagccatattcaagatatagaggacggcagactgaactcggctttacaaacaaaacgctttcaaatcagtgccgacatgtcgctcatccaaaaatgcgacatcattgtgatatgtgtgccgacacccctgaacaaaaaagacaagatccccgatttaacctacatcgacagtgcagttgacagcatgatcgcttatggaaggcagcatcagcttttaattttagaaagcaccacctatcccggaacaacgaaaaaaaagattgccgacagaatggcatcaagccgcggcatgaaaataggaacagacttttttacggcttattctccggaaagaatcgatccgggcaacaggcaatatgaagtttcagatattcctaaagtagtcggcggaaccacacagacttgcacagaacttgcctcagcgttttacaacaccattgttacaagcattcacccggtcacctcacccgaagtagctgaaacagctaaactcctagagaatacttatcgttatgtcaatatagctcttatcaatgaaatggcgcttaattgccgtgaacttgatattgatatatgggaagtcatctgcgcggcggacacgaagccgttcggctttcaaaaatttatccctggccccggagtcggaggccattgtatcccgattgatcctttttacttcaaatggatcgcgaatgaaaaagggctgcagacaaaattaattgatctggcggacgaaatcaattctaacatgccgatttctgtctctgactatgctttgaaactggcgggcaaagacaaatgcagcatcttaataataggggccgcttataaaaaaaatacaaatgacccgcgtgaatcctcagtgtttacgataatggaagaattgatggacaagggatgcgcgattgattatcatgatccgtttatcagcgagatccgcttgaatgacggaagccgcaaacaatctgtccctttcacaaaagaacaaatcaatcagtacgacgtcatcatcattcatacagatcacgatgtaatcgactacagtattttgaaggatgcctcaccgattatctttgacacaagaaatgtatgcagggaaaaatcagccgacaattgcagagttgtcactttataggagggaacggtcattagtaatcgatttatctcttttcacagacctgatatgacaaacgaagaaatcgcaagcgtaaccgaaacgattcagtcgggctggatttcgaaaggcccgaaggtaatcgattttgaaaaaaagctgggagaatgtattggagccgaacacgtcatcagctgtaattcaggaaccgctgcattacacatggctttattggcgctcggtgtgggagaaggcgatgaagtcatcgtgccgagcttcacgttctgttccagcgtcaatgtcatcctgcacgccggagccgttcctgtgtttgcggatatatgcgagaaaagtctatgtgccgatcctgaagatgtcaggaagaaaataacgccgcgcacaaaagcggtaattgcggttcattttgccggctatccggctgatctggaaaacttgcagtccatttgtaaagaaaacggattgtatctgattgaagacgccgctcatgcgctcggtacaaaatataacggaagcatgatcggcactcacggcgatgccgtgtgcttcagcttttatgccaccaaaaatattacaacgggggaaggcggagccctcgtcatgaaagacgaacaggccgcagaaagagcgaggctgtacggctggcacggcatcacaaaaaatgcctggaaccggtacggtgaaaaaggcagctggagatacgacgtgttactgccgggctttaaatataatatgacggatattcaggccgcgctcggtctggttcaattgaagcgcgcaaacgaaattcaagaaaaacgggcacagatcgctcaattttatgtacgtgaactgtcgggccaatctgacaaagcagcgcttccgctttctgacattccgaacggcataacgcactcatggcatttatttattttgcggatccgagagaacggcggcatggacagagatctgtttattgagaaaatgaaagaaaaacagatcgggctgagcgtgcactttattcccgtgcatatgcatccttactatcaaaaacattttccggccgagctgccggttactgaacgtgttttccgggagatcgtgtcactgcctctttacagccagttatcagatgaggattgcagctatattgtcaagtctataaaagaagttttgactatcagccaggaggtaggatcatgaaacatattgcgattatcggaggagccggttttatcggaagcgaattggcggcattattacaggctaaaggttatcacaccattattgcagaccaaaaggagccggcttttgacactgaataccgccaaacggatatccttgatcggacgtccctccgcgaatcactgcggggagcggatgcggttgtccatttggcggcaatggtcggtgtagacagctgccgaagcaatgaagaagacgtcatacgggttaattttgaaggaacgaaaaatgtcaccgaggtatgcggtgaattgggaatcagaacacttcttttctcatcgagctcagaagtattcggagattcacctgattttccttataccgagacaagcagaaagcttccgaaatcggcttacggaaaagccaaactgcaatcagaggaatatttgagagaacaggcttccgacaagcttcatattcgggtcgtccggtactttaatgtatacgggccgaaacagcgcgaggattttgtcatcaacaagtttttcagcctggccgagaatggctctgagctgcctctttacggggacggcggacaaatacgctgcttcagctacatcagtgatatcgtcaccggaacttatctcgcgctcattcatgaaggagccgtctttgaagactttaatatcgggaacgaccagccgatcacgataaaagaactggctgaaaaagtcaatgtgctctctggcagagagaaggataactatctgtttaaaaagctgggcgaagacggcgtgaggggaaaagacatcgagatttttaaacgggcgccgtcaatcgagaaggcgaaacgtttactcggttacgatccaaaagtaagtctgaatgaaggcctggagatcataaaagatgaaagacaaaagcacaaactttcactttcctgaaaacccggaagtagtcaaatatcccgtttatcccggacagctttccgtcagggaccgtctgcgcgcggtgaagcacttgcttactggcggacaaagcggactgactgaaaaactggaaaaacggtacggaaaaggggttgtgctgacctccagcggcagtgcggcactggtgctcgccttaacttattcgggagccgggccggggaaagaagtgattttctcatccttcagctgcccgaatgtcattgatgccgtattgcaatccggtgcaacgcctgtttttgcgcagctggatgagcatctttctttatcgtttgaggatgtcaaaaaaagagcgacgcggcagacgtgtgcggttatcctcacgcacgtatacggccggagagaaaataccgccatcattgactgggcgaaggaacacggtatttttgtcattgatgatgccgctcaagccatgtttacaaaacaagcggatacatatgccggcggtctgggcgatttcggtgttttaagcttcggcccgtcaaaaccgcttgcgagtatcggaggcggcgcgttaatcgcgccgaaagaatggcttcggcaaaaagcaaatttcccgatggaacagcgcagccaagtggcagctgactatcgaatttatatcagaaatcaaagaatacaggctgttatgaaacggaaacggcatcatcccgtttcatatatttataggaaagcgggcatcatgccttccatgaaagccactaagctcgaagctctgccggataaaccggctgttgtaccggtgcttcgcatgcatccggcaagggaagccattattgaagatcagctttcacttatggatcagcttgtaacagcttcgctccgaaacttacaagcggcgggagaaatctttataaaggcggaagagacgtacggcataaagatgatccagccccaagaaggagaacatctgaattatttaacgattgtattcccccgggatgaagagcggtacgggtgttccgtttatttagctgaaagaggcatccaaacatgctggaactatcttcccctcggacgtattccgatttatgaaacatatgcggcggaagaaggggaagatccgctttggaaaagagttctttctctgccgtttaaacctcctcttcaaaaggagcaagtcagatatatagccgaatccgttttatcatattgtgagcaaaagaataagactgaatagtggtgataacaatgcaaaaaacagcagtatgcacgagccgccaggcatgggatcgggccgctgacatgtatcaggcggggttgtttcaaagctatgattggggaattctcatggaagagcttcccggcacgtcatttcaccctgtcagactgacaacggacggaggacaggtcatctatcttccgctttttgaacagaagggcgtattatccggcaatatgatcggatacggcggcgttatttcagatcgccccatctcatttgaatggcttcaaagtgaaatcgaggccatattcggccggaacatatcccggatgctgctgccgtacggtcagacttcttttacagaagaaatcggggaagggtggacggaaaaggcgacacggattcttacgcttccggacacgtttgacgaactttggacgggcatttccggaaaagcccggacggcagtcagatacgctgaaaaagagaatattgtcaccaggctgatcgggcgacaagaacttgaatcattttacgacctctacaaggagcatacggcggcaatcggcgctgcttatgtgctgagccaaggatttttccaaaaactgcttgacacgtttggggaccggatgttttgggtcggagcatatcaggatgagacgctgatcagcagcagtatttttctctatgaccgctctcatttctattattggcagaatgtaaacagcctggcgggaaaaaaagcgcaggcctcttacttgttgatgcgtgacgctttgcaattcgccatttgccgcaagcttcaatgggctgattttggctattcacacagtaaagaaatcgcaagaccgaaacgatattggggagctgaagaaaaacaatgccgactttttacgaaaccggaatgaaaacaataagcggccatcaatccagttatctgccgtggtacggtttttttgaaaaaatgtataagtcggatctgtttgccattcatgacacggctcaatttgagaaaaaagggtttctgaaccgcaacagaatcaaaacgccgcagggccccagatggctgacggtgcctttgcagatgaaacaatataaagacatagagcttcggcatatgaaaatcgaccagacacaggattggcggaaaaaacattggatggcgattaagatgaactatgcgaaagctccctattttgagcggtaccagcatttttttcaagatgtctatcagagggagtgggaatatctccatgatttgaatatgcacatcattgaatttttccgaaaagagctccgaatcgaaacgccgctctgttatgtctctgagcttgaatgccggaaggagaaaaaaagcgattttgttttagcgctttgtcaggagctgggggcggatcgttattattcaggcagtcagggttccgactatttaatagaaagcgattttgaaagaaacggaattgtcattgagtatcagcagatccggcattttgactatcctcaattattcggggagcatatccctcacctctccatgcttgatatgctgatgaactgcggagcggatacagctgaaatgttagttaaaggagggcaatatgatgaaagtaatggtatttgcagcgcatcccgacgatgaaattatcggcgtcggcggcacgctcgccaaacatgtccgccaaggtgacagcgtgtcggcagtcattatggcggaaggcaagtcatcaagaaaaacggattatgagaagcctgaagagtctgttatgcagcattctgctcaagaaacggaacaagcgctcagcactttgggcatccatgattttgtcaggctgaaccttcctgataacagaatggattcaatggatttgctggatgtcgtgaaggaagcggagaaacaaatcaatcgttttcagcctgacattgtgtatacccagtacggcggtgacattaatattgaccactccgtcgtattcagagcggtcatgaccgcaacccgtccgcttcccggccatacggtaaaacgggtttttgcctatgaaacattgtcttcgacggaatggaattactgtcagaaggatcagtttcatgccaatttcttcgttaatattgaagacgagcttgaaacaaaattgaaatcgatggcgtgttacggctccgagctcagagacttccctcatccccgctctttgcaggcaatcgaacataatgcccgtgtatggggagcaaaatcgggtttttccgctgcggaagcgtttatgcttgtgagaggaacatggtgactgtcctatgattgctcaaattccgtttttcggacttgatccgaagcaaatcgatgagaaatgggtggaagcgggatacggtctggaagcgaatatttttgacggccgctcctttagtgaagcggattatctcaaaacattcaatcagacgctggaatatgcaaaacagcttgatccttcattattgacgctgcatttcccgacagatcatgccgattatgtgcatgaagatcacatcaaaaaacagctttatcactttgcggagctcgctgtgaaatacggcgccaaaggcataaccgttcatgcgaatcaatttatgacggttgaggaatttcaagtgtatgacctggaaggaaaccgtaaaaaaatcattgagtttttcgcagagtttgatgagcagctgaaagggacggacatttggatcggtgtggaaaaccttccgatcatcgggaatctgggagaggattttgatccgattttcatttatcctgaggattttacagagctggttcagctggatctgaagcatgtcggtattacgtgggatctgtgccattgggcgattacctatcagactcacttgtcttccgcgcttatgttcagaaatgaccagctgagatacccggatttctttcagtttctctcgataaaagagagcattaaacattatcacttcagctcatttcgccagcttgcgttcccgcatggcggcgtccgctgttttgagggccgccatccgagtgaagggacgatcgctgaggagctgctgagacgggctgccgatactttgcaggagctttatcggaatcaagataccggcattgtatttgaggtgatggaagaggattatacggaaagacgggaatcatggagaacgctggaatggttcggcggtgtttctgatgccgaggatcaaaaaagggcctgatatgacatatcgaacaccgaactatgcaaagctttggtgtgcgcaggtgttttcttcagcggcggacggtatctggcttattgcactgccgctgttagtgctggaattgaccggcagtaaaattcttgtcggcgttatttcttttatcgaactcgtgccgttgacatttggcgtgctggcgggaccgctgattgatttattccgaaaaaagtcgatcttgtatttgtgcaatacgggccgggccgtcatcatgatcctcttggcggtgctcagcgcgaacgatttattaaccgtgtggatagcaggggtgtgcgccttttgtctatctctgcaatcgatgctgtttgcgccggcgaaagtcgcgatcattccgctgctcgtccgcaaacagcatcttgatcaggcgacatctctgatcaatacgagtgacttgatcggactcatcgtcggaaaactgatcagcggaatcatgattgcggctattccgttcgggctgctgtttgccataaacggaactgctttttttatctccgcggcatttatcgcgttcattcgtatttcagaacagcccaatgaaaaaagcaacggggctgaagatgtaaaagccggctacagaatgctgaaaggaaatgcggcatggctgacatcggtcggatactttttcgtcgtaaatctcgtcattgccggtcttatttcagtaatggggccgattcttgctgtggaacgttttcagcagaactattctgtatggtttgccgtcatgtattcaatgtttcaggcggggatgcttttgggcaatctggccgtatttttcaaatggaatacaaaacgcttgaaccggctgtatccgcggacgttaacggcagcgggactgctcattttggtgctgttttttccgcttcacgggtttgagtgcatcattttcctggtgcttggcatcatcatctcgtatattgatgtgcaaacggtgctgtatttccaaaagacggttccggccgcatatttcggaagggtttttgcactgattttttccattgtcaaaatgggtgaaccgctgtctgccgctgtctacacagggcttctgctgttgatgaatgcggattatatttttgcggcggtcggactgacccttacgatcgtttttgctgttttttcagtcagacaagggagtcaaagaaattcagagaaacaagcggatcaatccgtctgaatggtaaacgaaggtgcgccggtatcagccggcgccctttttatcataaatccaaataaagccgtatcatatccaggcattgaatgccgttttcaaaaatgtcttcatcataatgtctgataaaaaaatcatggtcgacagcctgaatgcggaatccgcatttttgatagagtgacagctgatgaatactggaatttccggtgccgatttcaatcgtgtcagctcccgattgtctcgctttttcaatggcatcttgcaccagctgttttccgaatcccctgttctgcagcgattcttttaccgcgatgtttacgatttctatcgttttaggccttgtttgcaataaaacgtaaacccctgcaagctcgtctgacgtccaagccgtatagcattctcctcttacaagataatcatcgacaatctctttcgacggatcggccagcagcaatagttcatacagcgcttcatccggatccgcggcttttcggatgctcagtttttgcatgtccgtttctcctcctccgttatgatcgacagctatttttcaaaataactccaaaatcattctactttattataaaatatgaaacataggaaaagttatacaagttttgtagattgaataggaggaaagtcatgtttttttgtaagtattgcggccgacagaacaacgaagaggcgcatttctgtaaagaatgcggaaaaccgatcgggaaaggaagccggcttgaacggcaggcggctgtaagagcggctgaacctgcttcacaaatgagaaagccgatccctaaaaaaacgctcttcatatggggcggcatagccgcagcgctgatcttattgattgccgcatataaaaccggagcctggctgacatctgaaaaaaggctcacggatcaattcgaacaggcggttcatgacggggacacgaaaaagctcgcagccctgctcactccttcagacaaaaaactgaagctgaatgagaccaatgtcaaaccgctccttgcatacgcaaagaaacacgatgaactgctggaaacgcttcgcggcaattcatcagaaaaagatgcggtatacgtcaaaaaagagggtaaaacccttcttttgtttgaccattacgaactgaaagtcgatccggtttatttccgcgtcaccagcaattataaaggcgccgatctttatatcaacagcgagaaaacagggacggtcaaaaaagccgatgaaacccaaatcttcggcccgtatgcacccggtgtctacacggcggaagccaagcttaaaaatgacacggttgacgttgtcaaaaagcaagaggcagaggcggccggcagccggaatgttgattttgatctgccgttagacgccgaggatgtgacgttcactccggcagacagcttcaaaagcgcgaaaggcgatctgctgataaacggcaagtccgtccataaagatccgtttacatccgttacatacggtccgctcttaactgacggttccatgacagccgccgtggaggctgattttccttggggaaaaatgaaaactgccgatgttccgatcaacggtactgatatggaattaacgcttatcccggatcaagatacacaacaaacaatcatggacacgattgtcaaaacaacgaagcagtatacaaaagcgatggcagacggaaataccgatcagatgaccgaggctggttccgcctggaaagagcagacgaaagaagtggtatccggcatgaagagttccggcacctttttgaaagatcagtataaagagacaagctttgatctggattcatttgcgatttctcaagagaacggccgctggcaagtaactgttacgggtaaagagcttcatgagtctgcttatttcgacgggaatacgaagcctgatatggaagaggctgagccgagctttcattatgtactctcatatgatacaaaacataaaaaatgggtttttgaaaaagctgatccagcctcagattcttctgggacaaatgtaaaaaaaataaaaaacgaccagccgaaaacctatacatccgcatgggcatcttccaaaggaaatacagcttcaggcagcgtgacaaacgagcaagtcacatcgtttatgactgattacctgacaaatcaatcaagcgccgtcagccttaacaattttgccatcatggcgggcaatttagaagagggaagccctttgtatgctgatcagcagaaactggtcaaaaaactgtacagcgaggggacgactgaagtatttaataaagtgaatgtcaaaagcttttcacagaaaggctctcatctgacgattcatacgtacgaggagttttatattacgaaagccggcggcagtccgaagctcagaacatacaattggacgtatggcggcgttgtcaaagacggaagaatttatttaacatccattcaataaaaaaacccccgcgccaatcaggcggcgggggtttccgtttttaaaagaagaaataattcatgagttctttcatataatgcttgatcgtgaattgaaacgttacgcaaatgatcaaatagatgacgataacagaataaatgatatccgccttagcagtgagctgatgctgatagctcgccagcatgagcggaggcacggcaaacgccgctcctaaaagaccgacagccagaatggtaaagcaaacggttgtatgaagcagcataaaaatgagggcaagaagcaaaatagctgtaaacggaatcaaaaatgctccgaatctggacagcgaatctttaaatgacacctgcgcgccgccggccttcaaagcgataaaaatcaagagatacaggcagaaaacgcataatgcaaaggtaagcgccggtttgatcacaaccgcggtaaaactgacgtcacgaaagccgtctgataagagaatataaaacataatcggcgtcaccaggcagaaaagcaccatgttgatgatgctgctgacaagctgttcgccgcctgtcgttttacatgtttgatacggtctctttaacacatcaagcacgaataaggcaaattgctttgaagcctgcttagccgcggcgccggcctgagcggcctgaccctgtgtttggcctgcgcctccctgcccgggctggggcgcaccgcatttttcacaaaattttccgccatcagtatgatggccgcattgagaacaatacattctaaaactccttttacaagtaatatagggattttgttcaatatttacattataaaagaaaataggacggatgtaacggagttttctaaagatatataaatcaccttctctatgaattgataatagagaaaaagtacccattatggtagaattttattggagctgatagatatcatgtctctcggcgcattgattcagagtgaaaaaggaaattaacgcatgctaaaaaaattgaaaatgctttatcggctgttgaaattcggaaaaggcttatggagatagcaaacagaaaaaaaccgtccttacaaggacggtttttttctgttttccggatcgtccggctgaggttataaaaagcagaccccggggtaaaaatcatgcataagaaacagcggagaacaaaacataactcaataacggcaagtcataaggaggtacgcatgttttcattcatcattcatgtcttcatttcactgtttgcagtctccaatcccatcggaaacgtgccgatttttctttcactgacggaaggatacccggagaaagaacggacagcgatcgcacgcaaggcttccgtgctgtcgtttatcatcttggctgcttttttaattttcggccatctgatctttaaactgttcgacattaacattcatgccttgcgtatcgcgggcggcatttttattttcggcatcgcttataatcttctgaacgcgaagaaatctcatgtacagtctctccatcatgaagagaaaggggagagcaaggagaaagccgatatatccgtgacgcctttgtcgattccgattatcgccggacccggtacgatcgcgacggtgatgagtctgtcggccggccatggcggcatcatccattacatcagcgtgcttatcggcattgcggccgtcatcgcgatgacgttcatcttctttcactattcttctttcatcagcaataagctcgggaaaaccgaaatgaacgtcattacccgactgatggggctgattttggcggtggtggcgatcggcatgatcggcgccggtctgaaaggcatgttcccgatattggtttcctgacttaaaaaagcagcgcccggttatcttcgggggctgcttttttctattttcggcacatgctgaaacacttcttcactctcaaaaaattctatcaaacggctcagccagtcataataatggagccaatccgtcagttcatccaaaagctgacgggctttttcttcaatatcgggactgagattttccgattccagaagctcagtcagctcgcggttcagctttttatagagcattttgtttttgctgaccgcctttgtccaatttgccgtaaacagggagataaacgtctggtaataatcacgctccacgtcgtaaaggtctttgcgaacgcctttttcaaacactttttccgccagattggcatcagtcatttcacggaccacctggctcatcctcgttttgctcatcccggttgcctctgacagctcatttaacgtcatcggcttgcggttcatataaataataccgagcacacgaccaagtgtggccggcattccgaatgtatgcatattctcggcgattctctcaatgagatgctcttcagcatgcccgatgatatcaagagcgtttttttccacggctgatcatcccttcactggcttttcatgctgacaatatatcatattttttacagttgatgaaaaagatgatgcggcaggatatgcgagctatcgggagcgattgtaagaacatccgcattgtcagcgggataacatgaaaaaatacgtatattgtatataatttcaacacattgtaaactttttattttacaaatttcatcttataataaagattatacttttcagaaaaataacggaacccttcggaggtgcacggattgctgagattagaaaatgtatcgaaagtctataaaggcggaaaaaaagctgtcaacagcattgatttaaatatcgaaaaaggcgagtttatttgttttatcgggccgagcggctgcggaaaaacgacgacgatgaaaatgattaacagactgattgagccgtcatccggaaagatttttatcgatggcgaaaacattatggagcaggacccggtggagctgagacggaaaatcggctacgtcattcagcagatcggacttttccctcatatgaccattcagcagaacatttctctcgtgccgaaactgctgaaatggccggaacaaaagcggaaggaacgggcgcgggagcttttgaagctcgtcgatatgggcccggaatatttagaccgctatcctcacgagctgagcgggggacagcagcagagaatcggcgtgctgcgcgcccttgcggcggaaccgcctcttattcttatggatgaaccgttcggagcgcttgacccgattacacgggattcccttcaggaagaattcaaaaaactgcaaagaacattgaataaaacgattgtgtttgtaacccacgatatggatgaagcgattaagctggctgaccggatcgtcattttaaaagcgggagagatcgttcaggccggcactcctgatgacattctccggaatccggctaatgagtttgtcgaagaatttatcggcaaagaacggttattgcaatcaagaccggacattgagcgcgtcgagcagatgatgaacaaaaagcctgtcaccgttacggcggacaaaacactttcgcaggcgatccaagtgatgcgggagcaccgtgtcgattccctgcttgtcgttgatgacctgaatgtgctgcaagggtatgtcgatgtcgagatcattgatcagaaccggaaaaaagcgagcctcgtcggcgacgtgctccgctctgatctgtatacggtcgagcagggtacactgctgcgtgataccgtacgcaaaattttaaagcgcggaatgaaatatgtacccgtcgttgatgaacaaaggcatttagtcggaattgtcacgcgggcgagccttgtcgacatcgtttacgattcaatctggggcgaggaagaccagctggtgacaggctgacaaggggaggaacgcttacaatgaatgaaatgatcaagtttttgcagacgaacggcggagaactgttatataaaacgtgggagcatttatacatttcgatcatcgccgtcatattaggcattgtcgtcgccgttccgctcggagtggcgctgacgagaatgaaaaagggcgcaggcgccgtcatcggcgccgtcaacattgtgcagaccttgccgagtctcgcgatactggcgttttttatcccgctgttaggcgtgggaaaggtgcccgcgatcgtcgcgctgtttttctattcggtgctgccgattctccgaaacacgtataccggcattcaaggcgtaaacaaaaatctgctggaatcgggaaaaggcatcgggatgacggtctgggagcagatcaggcttgtggaactgccgcttgcggttccggtgattatggcgggcatccgcacatccaccatttatctgatcggctgggcgacgcttgcttcctttatcgggggcggcgggctcggagactatatttttatcggcctgaatctctatcagcctgaatatattatcggcggcgccgtgcccgtcaccattttagccattatcattgattatctgctggcggcgacggaacggaaggtgacgccgaaagggctgaaaggactgaaggaagtatcataaggagttggctgttttgaaaagaaaccaaaagagatggatgtgcgcactggcgctgtcagctgctctgcttctgggcggctgttcccttcccggcctgagcggggcttccgatgatacgattaaaatcggggcgcaaagcatgacggaatcagaaattatcgccaatatgctcgcacagatgattgagcacaatacagacttgaatacggcattaattaaaaacctcggatcgaactatgtccagcagcaggcgatgctcggcggtgaaatcgatatcgccgcgacgcgctactcgggaacggatttaacgagcaccctcggcatggaagcggaaaaagacccgaaaaaagcattatctatcgtccagaaggaatttgagaaacgcttccattacaaatggtttgattcttacggatttgagaacacatacgcttttaccgtcacgaaagagcttgcggaaaaagatcatttagacaaagtatccgatattaagaagcatgcggatcaatttaagctcggtgtagacaatgcgtggctgaaaagaaaaggcgacggctataagggcttcaccgacacgtacggttttgaattcggcacaacctatccgatgcagatcggacttgtatacgatgccgtgaaaaacgggaaaatggacgccgtcctcgcttattcaacggacggacggattaaagcgtacgatctgaaaattttaaaagacgacaagcagtttttcccgccgtatgactgttcgccggtcattcccgacagcgtgctgaagcagcatcctgaactgaagggcattgtgaataaactgatcggcaaaatcgatacggaaacgatgcaggaattgaattacgaggtggacggcaagctgaaagaaccgtccgtcgtcgctaaagaatttttggagaaacatcattattttgaataagaaatgaggtggggcaaatggaagtgctgcagcagctcggcacttattattctcaaaacggggcctatgtgcttcaggagttttaccgccattttctcatgtcggtatacggcgttttatttgcggcgatcgtaggtgtcccgctcggcatcttcattgccaggtacagaacattaagcggctgggtattcgcggtgacaaacgtgattcagaccgtgccggcgcttgcgatgcttgcggtgctgatgctcgtcatggggctcggcgccaatacggtgattttgtcgctgtttttatattcgcttcttccgatcatccggaatacgtacacaggaatcgccagcattgaacacgcttatcttgaatcgggaaaagcgatgggcatgaccaaatttcaggtgctccgcatggtggaactgccgcttgcgctttccgtcatcatggcggggctgcggacggcccttgtcatcgcgatcggcattacggcaatcggaacgtttgtcggcgcgggcggactcggtgacatcattgtcaggggctcaaacgccacgaacggaacagcgattattttagccggcgccattccgacagcgctgatggccgttatcgcagatcttgtgatggcatggctggagcgggcgctgagtccggtgagaaagaaaaaacgaaccaaagcgccgaatgcggcatgaaaaaaacgccttgcgggtcagggcgttttttttcttatggcttcggaacatgcttgaatatttcttcgctttcaaaaaactcgatcagacggctgatccagttgtagtaatcaagccaatcctttaattctttcagcagttcgttgattttttcctcagcttcttccggcacgccgttttcaaggacggccgtcagttcgcggttcagttttttatgcatcattttatttttgctgacgaccttgctccatgtggccgtaaacagcgtaataaaggtttggtagtaatcctgctcgacgtcgtataaatctttgcggacgcctttttcaaacactttttccgccagattgacgtcaagcatttcacggaccgcctggctcattctcgttttgctcatgccggtcgcttctgataattcagttaaggtcatcggcttgcggttcatataaataatgcctaaaatgcgccccaccgtcgcgggcattccgaatgtatgcatattttcagcgattcgttctatcaaatgatcttcagcttgttcgattacgtgtaacggatctttctccaacagtttcaatcctttcagtcagcaattccgatgtcaatataccacatttttaaaccggcggaaatgctcttccgagagaatttggcagtaattcggagcaataagaagaactttgccggtcaatacgggtaaatcagtgcttacacaacctttatatataatatggacaaattgtaaactttttaatttacaaagtttaatttataatgggaaacgttcaattgtctgaaaagttaaatttgaatttaacgatttgaacaaatttaatatcggaggtgtgagtgtttgctgacattagaaaatgtctcgaaaacgtataaaggcgggaaaaaagccgtcaacagcatcaacctgaatatcgacaaaggcgaatttatttgttttatcggaccgagcggctgcggcaaaacgacgacgatgaaaatgatcaaccgcttaattgaaccgacagaaggcagaatcctgatagagggccgaaacattatggaacaagacccggtggaactcagaagaagcatcggctatgtcatccagcagatcgggctgtttccgcatatgaccattcagcagaacattacgctcgttccgaagcttttaaagcattctgccgaaaaacggaaggaacgggcgcgggagcttttaaagctcgttgatatggggcctgaatatttagaccgttaccctcatgaactgagcggaggacagcagcagcgaataggtgtattacgggcacttgccgcagagccgccgcttatcttaatggatgaaccgttcggggcgcttgacccgattacgagagattcccttcaggaagaatttaaaaaactgcaaaaaaccttacataaaaccatcgtatttgttacccatgatatggacgaagccatcaagcttgcagacagaatcgtcattctgaaagcgggagaaatcgtccaggccggaacgcctgatgagattctcagatttccggcgaatgaatttgttgaggagtttatcggcaaggaacggctgattcaatcatccagccctgatattgaacgggtggagcagatcatgaatcccgatcccgtgacggtaacacctgagaaaacactgtcagccgccattcagctgatgcgtgccgagcgggtggattcgctgctcgtcattgatgaaaagaacgttctccaaggttatgtcgatgtggagatgattgaccgcaaacgaagacaagcggtaaccgtcgcggaagtgcttgaacgggatctgtacacggtcagaagcggcactctgcttcgcgacgccgtccataaaattttaaaaagaggcgtgaaatttgtgccggtccttgatgaggacggccggctaacgggaatcgtgacaagggcaagcctcgttgacatcgtctatgactccatctggggagaagagaatcagctcgcggtgatgtcatgaggaggcttcaattgatatgaatcagaccgtacaatttttacaggcaaatggaggagagatgctttataaaacatgggagcatctgtacatctcattaatcgccgtcatggcgggcattctcgccgccgttccgctcggcgtcctgctgacgaggatgaaaagaggagccggcgccgtcatcggcatcgtcaacatcattcaaaccttgccgagccttgccattcttgcgttttttattccgcttttaggcgtaggaaaggtcccggccgttgcggcgctgtttttctattccatgctgccgattctcagaaacacgtatacggggattctcggcgtcaatcggcaccttctggaatcgggaaaaggaatcggcatgacggcatgggagcagatcaggcttgtagagctcccgcttgccgccccggtcatcatggcgggcatcaggacgtcttcgatttatttaatcggctgggcgacgctcgcctcctttatcggcggaggcgggctgggagattacatttttatcggcttgaacctttatcagccggagtatattatcgcaggcgccgttccggtcacgatgctggcggccgccgtcgattacatgctggggtgacagaacggaaagtcacgcctgacgggctgaaaagcataaaggacgctttataaggaggaggtctcacatggggaatagatgcaaaaaacggctgctcgcaatcgcctgtctcggcatgctgctccttggcggatgctcgctcccgggattgagcgccgcatcggaggacaccattaaaatcggcgcgcaaagcatgaccgaatcggaaatcatcgcaagcatgctcggacagatgatcgaacatcacagcgggttgaaaacatccgttattaaaaatctcggctccaacgccgtacagcagcaatccttgatcaacggtgatattgatatcgccgcgacgcgctatacaggagacgcgctgaccgggacgcttcgcatggagccggaaaaagacccggacaaagcgctgcggctcgttcagcgtgaatttcaaaacagatatgacatgaaatggtttgattcttacggctttgataatacatacgtctttaccgtttccggacagcttgccagcaagtaccatttagaaacggtatccgatgtcaaaaaagaagcatcccatctgaaattcggcgtagataactattggatgaagctgagaggcaacggatatcaggattttatgaaaacatacggaatgtcatttgaaggcacgtatccaatgcagatcggcctcgtatacgacgcgctgaaaagcagaaagatggatatcgcgctcgcttattccaccgacggaagaatcatcgcttacggactgaaaacgctgaaggatgataagcggttctttcctccgtatgactgttcacccgtcgttccggatcatgtattaaaagagcatcccgaactggagggcgtgatcaataaaatgatcggcgcgattgatacaaagatgatgcagaaaatgaattacgaagttgacggccgattaaaagagccgtccgtcgtggccaaggaatatttagaaaaacatcattactttgaataacggaaaggagatgtgcggatggacacgatgaaagagttgtttacgtattacgctcaaaacggcagctatgttctgtatgagtgctggcggcactttctcatgtcggcgtacggcgtcgttttcgccgccgttttcgccattccggccggaattgtgacagccaggcacgggcgtctcgccggctgggtgtttgctgtggcgaacgtgattcaaaccgttccggcgcttgcgatgctcgccgtcctgatgcttgtcatggggctcggcgccaatacggtcatcacggctttgtttttgtattcactgctgccgattctcagaaatacgcacacgggcattatcaatatcgagcacgcttatctcgagtcgggaaaagcgatgggcatgacgaaataccaaatccttcgtatggtggagctgccgcttgcgctttccgtcattatggcgggtctccgaacggcgctcgtcattgccatcggcatcacagcgatcggcactttcgtcggcgcaggcggtctcggggatatgatcgtcagaggctcgaacgcgacaaacggaaccgccattattctggcgggcgccattccgaccgcgctgatggcggtggccgcagacctgctgatggcgtggctggaacgagccctcagccctgtgaaaaaacaaaaaagaaagctgatcgtacgctcagcctcatgaaaaaaagcattcttccgcgtgaaggatgctttttttgatttcttgattaaattttgataactgcgctgtaaagtcttacatatcaaataacaaagcagaggggtaatcatatgagcaacatcatagaaacgagacagctgcaaaaatcattcggcagacaacaggcagtggctgatgtgtctctatcggttaagcgcaacagtatatacggcctgctcggtccgaacggcgcgggaaaatcgacgactctcaaaatattgaccggcatgctgcagcaaacatccggcgaggttctgttcgagggacatacatggaagcgcgaagatttgaaaagcatcggttccctgattgaagcaccgccgctttacagcaacctgacagccgctgaaaatctgaaagtccgctgcgtgatgctcggactgcctgattcaagaattgcggaggtgctggaaattacgggattaacgggaaccggaaaaaagcgcgccggacaattttccatgggaatgaaacagcgtctcggcatcgcgttggcattattaaaccgtccgtcgctcttaattcttgacgagccgacaaacggattggacccgatggggattcaggatttgcgggaatttatccgctccctgcccggacagggaatgacggtgattttatcaagccacctgttatcagaagtggagcagatcgcagaccatatcggaatcatcagtgacggcgttttaggatatcagggagaaatcagccgggaagacgatctggagcggctgtttctggaggttgtcaaatcaacacgggagaaagcgggacaggaaaatgattcagtacatgcaggcggaacaccttacatctaaaagaacatttatcagaaagctgatcattctgattccgcttctgaacgcggctttttcttttctgctgaatgcggcctattttatgacgggcacgttcaattggtgggcggttattttcatgccgctcatgattgctctaatgtgcggtttatctgttaaaaaagagaaaaaatcagcgaatgaccgcgcggtgtactcattgccggcagatttaaaaagcatatggttctcaaaaataagtttgatcgcgctgtattcactcctgtcgcaaatcgtctttttagtcatcgtgtttttgcttggccttgtgtttccggcaattgctgcgctgcagctgaaaggcgttgaagcaagctcccttttgtggctgacgacgctttgggaaatcccattgtgcttatggattgccagacagttcggatttacggcagtcattctcatcaatatgatcgccgcctttgttttaggcattgtgccggcgtccggttcattgtggtggctgagtccgtggagctggtcagtccggctgatgtcaccgattctcggaatccacccgaacggaattccgcttcccgcaaacagcggcttattaaacggaaacgtgatcattccggctattattctttctattctttcttttatcgcaataagttttgtttccgcagtgtcattttcaaaaggaggaaaccggtcatgaccgtgcttttacgatatatgtgggccgatgtattaaaaatgaagcgcacgccgctcatatggatgcatgctgcggcgccggttttatgcgcgggatttttcctgttatatatgtatggaagggttcaggagtcttatatgctgtacagcgtctttttcagcgcgattgccgttttataccctctgatcatcagtattgtctgcggcatgtctgcctctgtcgaggaacaggcgggccattttcagatgatgctggcggttccgtattctaaaatcgtcagttttgcgggcaagctgcttctgctgctcctattgaatgtgttatcggttggtctcgccatctgtctttatttggcggggttgaaatttgttcttcacatcaatgatctcccgtatcttctctttttaaaaggaggggcgtggctgattgccggcagtattccgctttatatgatgtctttttttgtcggcataaagtacggcatgggaccgtccgggcttttagggggtgcgggattattaatggcggcgctcatgaatacgggacttggcgatatcatctggcgtttttttccgtgggcatggagcgtgaggctttcaggccttgcaggactgctgcattttgacaaagtcaaaaaagagttcctcccttatgtaagatacgatatgagattcggagaaataatgttatatttttctatagtgatattatgtctggccggcctctattggtgcagaagatgggaagggcggcgttcatatgaataaaggcaaggagcgattcggccggtggcaaacattttagcaattgatgatgaaaaagatattctcgttctgatcagaaacattttacagcgtgatcagcatacagtaacgattctggaaaaagcggaagatcagtcattggatttttttcaaggctatgatttgattcttcttgatgtcatgatgcccggaacggacgggattgaactctgccggcggattcggccgctggtggacagcccgatcctgtttttaacggcaaagtctgacgaagaatccattgtgaaaggcctcatgacaggcgctgatgattacatcacaaagccgttcggcgtacaggaattgatggcaagggtaaacgcgcatgtcagaagggaacggcgggaaaagcatcagacgaaacggctgatatcaggcttcatgtttgattttgacaataaagaagtatggatggatgaccggaaactgcctcttacgaaaaacgaatataaaatcgttgaatttctggcacagcataaaaacagaacattctcacgggagcagatttacgaggaagtgtacggcttggacggcgatgcgctctattcaaccattacggagtttatcagaaccatccggaaaaaatgtaaagaacacggggctgatccgatcaaaacggtgtggggtgtcggatacaaatgggaatagcaaaaggaaaatccagcatccgcaaagagcttgtcaaatttaccatcactttgtgtctgagcacgatgggggtggcggcattatgcgtcgccttaaatgccattgccatgaatgccggagcgatcctgcccgcaaactacagcgagcatgaggcggaacagatcaaaccccgcctgaaatcagcggaaaagataacagaagacatgatccccgcaggtatgacatacgccgtttttgataaaaaaacaaagcggatgacaaaaggaacgatgacggaacaagatgcggccaacgccagaaaaaagattcagcatacgccgtattttaattatgctcaaaaaggattcatggtgataaatcggaaagatgaatacggcgttctccaatattcactcaggtcggaatttcagtcgccgctgttaaggcgctatctgccgaattatgaatggacgggtcttacgattctgatcactttgcttcttttgactgtttttatcgtgacgacgcgtttcgccaatcagctgagacggcatttcagcacactcagctccattacggcaagcattcaaaaacagaatttaaatatcaatccaaaaaggtcgcgtataaaagaatttgacgatgtcattgactctctgctgaaaatgaaagacgcgcttcaggcatctctggcggcgcagtgggaggcggagcggataaagaaagaacagatcggcgcgcttgcgcatgatattaaaattccggcaacgatcattaaaggaaatgccgagctgctccagttaacagaacctgatgaggagcaggcggaatatgcgcagtatatcctggatgccggaaacaaaatcgagcattatgtcggacagctgatccagctttccaaagcagaggaggcagttgccgttcatgtcgaatataccgacctcaaagagtggattcaaaacatatatcgtgacgcggcggcgcttgcggggccgaagcagatggatctcgtcctcagcgaacggggaattgaccgaatagaagcgccgatcgatcatgagctgctccacagggcggtcatgaatatcgcggcaaatgccgtcgactatacgccggaaggaggggaaatccgtgtggacgtcctgtgcaccgattccgccctccatcttgccgtatccgacagcggaagcgggttctcgccggaggcgctgaaaagagcgacacagcttttttacacggaggataaaagcagacattcggcggggcatcacggcatggggcttacattcgcccatcacgtcgtacatcttcatcacggcgaattaatacttgaaaatcaggagtctggaggagcccgggcggagattcgaattccgctggaaggcgtcagacaaaaacaagccctgcacgcctgagggcttgtttttctgtataagaaaagcaaaaataaaaacggctgtccgtttgagagatcagccgcttatgcggaaaagagtttatcaggaaggatcaatccatgttgaagaccacttggaaatttcctctaaaataggggctaatgcgcagcctttttccgttaaagaatactcaatgcggacaggcgtttcggggataacatcccgtttgatgacaccttctgtttcaagttctttcagacgttctgacaagactcttccgcttaaattcggaagcgccgcttcaatttcgctaaatcgctgctgtccgttcaataactgaaagacgattagagccacccagcgtttacttaggatgtcgaccgctttttcgaatctggggcacatttctgattggttcatgctttttcacctcgtcttctgctattataccgcaaaatcggagggaacgtacgtctggcgcttgttaagttgaggagaggatcaaaaagaggatgaggaatccggggagcgttttttcgcttcagccgcaataaaatcaaagtatttgctgacgctttcaatatcttcttttgtgaagtgctgccactttttgctgtcaaacagcggcagatgctccgcgcctctgtcaacggcggtctgatagatggcgcagatggattgatagctttcggaggtttcacggatttcctcctgaaatgccttgatgtgtccggcccgcgccattaactcctcgtacgggatttttaatgtgtccgccaattttctgatggtcgcgggtttaggaatgccgcggtgcccgttttcaattctggaaatggtcgccgagctgacgccggaatagacggcaagctgattgacggtaagcttccgggcgcggcgcagctctcttaattgctttccgaatgtgttcaataagatcgcctcacatgtgcaaagtcatgagtcttcatttgttctttttttggcttccgccgataagaacgcaaagtatttatcaagcagaaccaagtcttctttcgacaggtgccgccagttctcccgctccaaaagggataaatcatgcagctcatacgtttcggctttttccagcaaggtgcagcccgtgtcgtacggggctctcgtttcctggacggtctctatgtatcccgccgtctgcatcagttcctcatacgggatttttaacgcatctgcgagctttttaatggttgcaggtttcggcactccgcgtttgccgttttcaatccgcgagattcccgcggcgctgacgcctgaatacgttgccagctgattcactgtcagatgccttttttcccgtaatgtccgcaattgtttcccgaagctttccacagtctctccccctcccgcggtctatttatattctagtatgtttattgactaaagggaatagccaggctggaaaagtattgacaaaagttaacaaaagccgtatcttatgtataagaaagaaagtatttgacagaacggaaggtgaagaaagtggtcgaaaagatacagatcagaagagattatgtgctgcagtatatggtcaataatgactactcgttaaaccagctcgccctggagatcggaatatctcccgccacactgagccgtgtactgaatggagagcgaaggccgggccagctggtcatcggaaaaatgctctattactttgacatgaaatttgaagatcttttttactacgactttgttgacaaaagtcaatgaagatggaagattcaaacgcatttccgtttttctgacatgatgtacaccgatacggcgtgacatgcctttgtttttcatgtaaaatagaagcaatgtaggccagtcagtctggaggtgtatgggatgcacacattattgattaccttattggttatcgtcagtattgcacttattattgtcgtattgcttcaaaccagcaaaagcgccggtttatcgggtgcaatttcaggcggggcggagcagcttttcggaaaacagaaagcaaggggccttgatctgattcttcaccgcacaaccgttgtgctggcagtcttgtttttcgtgttgacgatttcgctagcgtatatcgtataaggcaatgtttgtataaggtctgatttaatatcaggcctttttcttgttgagagacggcgtttgtttctcgcaaaactgtggaaaactaaattgaatgtgcaaaaaaggggttatgagcatgaaaattgtgacaccaaaaccatttacatttaaaggcggagacaaagcggtgcttctgctgcacggatttacgggaaatacggcagacgtcagaatgctcggccgctacttgaatgagcgcggctacacttgtcacgcgcctcaatataaagggcacggcgttccgccggaagagctggtacatacgggacctgaagattggtggaaagacgtcatggacggttatgagtatttacggtctgaaggctatgaaaacattgcggcgtgcggactgtcgcttggcggggttttttcattgaaattgggttacactgtacccataaagggaattgttcctatgtgtgcgccgatgcacattaaaagtgaagaggttatgtacgaaggagttctctcctacgcgcgcaattataaaaaattcgaaggaaaacagccggagcagattgaaaaggaaatgaaggagtttgaaaaaacgccgatgaatacgctcaaatcgctccaggagctgattgccgatgtgcgcaaaaacgtcgacatgatctattccccgacatttgtggttcaggcacggcatgaccatatgattaatacagaaagtgcgaacatcattttcaacgaggtggaaacggacgacaaacagctgaaatggtatgaagaatcaggccatgtcattacactcgataaagaacgggacctcgttcatcaggatgtgtacgaatttttagagaaactcgattggtaacaaacaggaggtcgaataatggaaaaagaagcgtttatggaccgtcttctcgcgtttatgaaggaagaggcgtacaagccccttaccattcaggaactcgaggagatgctgaacatcacggaagccgatgaatttaaagagctggtaaaagcgctggtggcgctcgaggagacgggacagatcgtccgcaccagaagcaaccgctacgggcttccggaaaaaatgaatttagtaaaaggaaaaatttccgcgcatgcgaagggcttcgcgtttctgctgccggaggatacctctttaagcgacgtgtttattccgccgaacgagctgaatacggccatgaacggcgatattgtcatggtgcggctcaattcccagtcaagcggatcgagacaggaaggcacggtcatccgcatcctggaaagaagcatcgaccgcgtcgtgggcacatacacagaaacgaaaagcttcggctttgtcatcccggatgataagaaaatcacgagtgatatttttattccgaaacatgccaataacggcgctgcggaaggccataaagtcgtcgtcaaactgacaagctatcctgaaggcagaatgaacgccgaaggggaaatcgttgaaatactcggccataaaaatgatccgggcatcgatattttatccatcatccataagcacggcctgccgggagattttccggctgaagcgatggagcaggcaacaagcacgcccgataccatcgatgaaaaagacatcaaagaccgccgtgatctccgcgatcaggtcattgtcaccattgacggcgccgatgcgaaggatctggatgacgccgtcaccgtgacaaagcttgataacggcagctacaagctcggcgttcatattgccgacgtcagccattacgttacggagaattccccgattgacaaagaagcgctggaaagagggacaagcgtgtacttggttgaccgggtcattccgatgatcccgcacagactgtctaacggaatctgttctttaaatccgaaggtcgaccggctgacgctttcctgcgaaatgacaatcaaccagcagggacaggtgacggagcacgagatcttccaaagcgtcatcaaaacgacggaaagaatgacctattcagatgtcaaccggatccttacagaagacgacgccgagctgaaagaaagatatgagccgctcgtcccgatgtttaaagacatggaacgtctggcggaaattctccgggcgaaacggatggaccgcggcgccgtggattttgatttcaaagaggcgaaggtgctcgtcgatgaggaaggcgccgtaaaagacgtcgtcatcagagagcgctcagtagcggaaaagctgatcgaagaattcatgcttgtcgcaaacgaaacggtggccgagcacttccattggatgaacgtgccgtttatttaccggattcacgaagagccgaacgccgaaaaactgcaaaagttcttggagttcgtcacgacattcggttatatcgtcaaggggaaagccggagacattcatccgcgcgcgctgcaaagcattcttgatgaagtgcgggaccgtccggaagaaacggtgatttcaacggtcatgctccgttccatgaagcaggcgaaatacgacccgcaaagcctgggccatttcgggctggcgactgaattttatacgcacttcacatcgccgatccgccgatatcctgacttaatcgttcacaggctgatcagaacgtatttgatcaacggacaatcggacgaagcaactcaggaaaagtgggccgaacgccttccggaaatcgctgaccatacgtcaacgatggaacggcgcgccgttgatgccgagcgggaaacggacgatctgaaaaaagcggaatatatgcttgataaaatcggcgaggaatttgacggcatgatcagttccgtcacgaatttcggaatgttcgtcgagctgccgaatacgattgaagggcttgtgcacgtcagctttatgacggatgattattaccgttttgacgagcagcatttcgccatgatcggtgaacgcacgggcaacgtttaccgcatcggagacgaaatcacggtcaaagtcgtcgacgtcaataaagatgagagaaacatcgactttgaaattgtcggcatgaaaggcacccgccgtccgagagaaacaacaggcgaccgcagaaaacgaggcagaccggcgcggaaacgcgtgttaaacagcaataccccggcttcaccgccgaaatcggaggaaaaaggggaatggtttacaaaaccgaagaagaaaaagaaaaaacgcggcttccaaaacgcgccgaaacaaaaacgcaaaaagaagaagtaaatgcgaaaagcaaatagggcataatgctctgtttgctttctttcgcaagccgcattttcattgtcgcggaacgctccatttgctaaaataaagcgtatcgcacacatgaacggtttttgcggagagaggaggataaggcatgccaaaaggatcaggcaaagtattatcgcaaaacaaaaaagcaaaccatgattactttatagaagaaacctatgaaacaggcatcgtgctgcagggaacggagattaagtccatccgcgccggccgcgtaaacatgaaggattcctttgcgaaaatcgagcgcggcgaagtgttcctccacaacatgcacatcagcccgtacgagcagggaaaccgctataaccacgacccgctccggacgagaaagcttttgatgcaccggaaagaaatcaataagctgatcggcctgacgaaagagaaaggctattccctcgtgccgctgaagctgtacttgaaaaacggcttcgccaaagtattaatcggcctcggaaaagggaagaaaacatacgataaacgtgaagatttaaaacgaaaagacgccaaaagagaaatcgaaagagcgttcagagacagacaaaaaggcttctgatgcctgagccttgatgtgatgatatgccctgtgctatactgttcacacatcagattcacaggctgtttattgaagatattcccaattgaatttgcctgtgatcatggtataataacagtacagccagttgagcaagagcttgatagatctcccgtatacccttaacaaggggacgttacggattcgacagggatggatcgagcttgagctgcgagccgagaggcgatctcgttaacacgcacctaaatataactggcaaaactaaaagttttaaccaaaacttagcactagctgcctaataaacgcagcgagctcttcctgacattgcctatgtgtccgtgaagagcacatccaagtaggctacgcttgcgttcccgtctgagaacgtaagaagagactgacagactagctctcggaaggcccgcccgcaggcatgaagacgagtgaaacacgaaatatgcaggctacgctcgtagacgcttaagtaatcgatgtttctggacgtgggttcgactcccaccgtctccatacataacagaggaaccgcagtgccgtcacatgacgcactgcggtttttttatgccgacaaaaaggagtgaatgtaaatggaaatcgtcatcatagacggaaaagatgttacaagcacagaagctttacaccgaatcttaaaagatcaattagatttcccggacttttatggtgaaaatctgaacgccttatgggattgtctgacaggctggatcgaacttccgctgactttggtgtggaagaattttgagatcagtcagaaggaattgggttcggatgctgatgatgtcttggagctgtttcaagaggctcaggcagaattagatggtgaatttttcattcaaattgatcagccgtcagccgggacaacggacaggcactaaaaagtgcgtacttcccctcatccatttttctatccgataatagggacggaaggtttcaggctttcgatttctgtccatatataagaagagacttgcgatagggaggaatggatgatggacttgcagttgaaagggaagacggcgcttgtgacgggatctacgtcaggcatcgggaaggcgattgcggcttcgctgattgcagaaggtgcggccgtgatcattaacggccgccgtgaagaaaaggtgaacgaaacgatccgggaactagagaaacagacgccggatgcccgtctctatccggccgcgtttgatttaggcacggcggaaggatgcggcgcgatttttcagcagtatcctgatgtggatattctcgtcaacaatttaggaatctttgaacctgcggaatactttgatattcctgacgaagagtggctccggtttttcgaggtgaatatcatgagcggcgtgcggctgacacgccggtatgcaaagcggatgattgagcggaaggaaggacgggtgatctttatcgcgagtgaagcggccgtcatgccttctcaggaaatggctcattacagcgctacgaaaacaacgcagctgtcgctgtcacgcagcctggccgagctcacggaagggacgaatgtgacggtgaatacggtcatgcccggctccacgaaaacagagggcgtcgaaacaatgcttgagtcgctttatcccggtgaaaacttgacagcggctgaagcggagagacgatttatgaaggaaaatcgtccgacgtccatcattcagcggttgatccgtccggaagagatcgcccactttgtcgcctttttaagcagcccgctgtcgtctgccattaacggatctgcattgcggatcgacggcggcttggtgcggagcattatataagatgaacataaaaaacccccgcaaagtggcgggggtttttttaatgcggatcacgctgaaaccggctgatgatcctgctgattaaatcttttgttgcacagtcaaagtgctcttctttttggtttgtcaaaagcccgacaggcggtgaaattgttaagttatggatcggaatgaccttcgtgccctcgatcggctctgaatgcgccgtcgccgtaaagattgagacgccgatattttccctgacatagtattgatgagccatgctgctggtcagctccatttttcgatagcggctcccgatggcccgctgcaggtgctgttcaatttgaatccggatcgggcaattggcgggcgtaaaaatcaggcattcattttctaaatcttcgagattaacgcttgctttggcggcaaggggatgtctgtctgacacgatgacattgagcgagtcatggaaaaacggatcgaaataattttccagaatcagctccggctcgccgcataccgcaaaatcaatagcgccctccagcagtttgcggctgcatgtattggcatcatccacgctgacattgaccgacatgtccggataatcatttaagaaaccccgcagcacggcagggaagatcaggcttgccgtcggttcggatatgccgatctgaataaggccggcctggccctgtctgatatcggccagagtatggtcaagcacctcgtattgcgcgagaagctgcccggcccgctcatgaaacagccgccccgcccttgtcagcttcagcttctttccacgttcaaacagctgcgcgcctacatcctgttccagctgtttaatccgcattgaaatcgtcggctgtgagtagttcagaatttctgcagccttataaaagctgcctgactgtacgatggtatgaaacgttttaatggttcgtagttccaacgaaatcccctcccggctgttcattaattttcttgaacctttcctttactttttttgattagtcaaacaaatcagtttgctttatagtataaacaatcaaagcttagtaaacaaattggaattatatattttttgcggggagagtgaccggaatgagtgaagacatatttcgattggctgagaaaaaggatgcgccggagtttttagagctgctgtacagcgcgtttcagccgatccgcaatttggagattgactggccgtcggcgcgggccgacatcgatatggtaacggaaaatattgaaaatcattcagccgtcgtgctcgaacgggatggacggcttctttcaaccattacgatccgttttccgtgggagagtgacacgcctccgtcaaaatatccgtttgtctggtggtttgcgacgcttcctgagctgaaggggcagggcatcggcagcaaacttttgacttatgtggaggaacatgtgctgcgggatacgctgaaggccccggccatcacgctcggcacttcggcgcgcaagcatccctggcttgtagatatgtacagacggaggggatatgaagtgtattttgagcaggagaaagacggagacatcggagttatgatgagaaaggtgctcataccggagcggtttgacgcgtcgctgttaggcacaccgagctgggcgcaatgatcaaaaaacggatcagagccggctgtctgcttctgctgctcggcgtgctggccgggtgcgggcaaggagaaagcgcaaaagcggggagcggcgtgcagaccgtcatcgtcggcacgggaactgattttccgaacattgcttttatggatgaaaaaggcgagctgaccggctatgacattgaagtgatgaaagccattgatgaacagctgccgcaatacaaatttgtctttaagacgatggatttttcgaatctgcttacaagtctcggaaaccggaaaattgacgtgatcgcgcacaatatggcgaaaaacaaggaacgggagaaacgctttttgtatcacaaaatcccgtataactactcgccgatgtacatcacggtgaaggcggataatgacgcggtacgcacgctccgggatttaaaagggaaaaccgtcatcgtcggcgcgacgtcaaacgcggcggattatatgacggcatacaacaaaacccacggcagcccgatacatttgaaatacgccgggcagggcggcaatgatacagcgaaccaaattgagacaggacgcgctgacgccaccgtatccacgccgtttgccgtcgattttcaaaataagacgcacgcgttcaaacaaaagacggtcggtgatgtgctgctcgataccgaggtgtattttatgttcaataaaaacagccaaaccctggcggacgatacggatcgggcgattcaaaggcttgtgagggacggcacattgaaaaggctgagtgaaaaatggctcggcgcggattattcaaaatcaagtttcacgaaataattgaagcagaaaacggggcgatcacatgaaaataagattggcggtcatgtcattaacaattgcggcaacggcggcgttatcagcctgcggcgcgggaggggaggcggcatcaggcaatcagaaaaacgtgaagaacattacggtcggcacggggactcaattttcgaatatttgctttattgatgataaaggcaaattgacgggctacgacgttgagctggtgaaagagcttgacaggcgcctgccggactatcgatttacctttaaaacgatggatttctccaacctgcttgtcagcctcggccagcataaagtcgatatcgtggctcatcaaatggagaaaagcgccgaacgggagaaaaaatttctgttcaatcaagtcgcgtataacaacttcccgctgaaaatcacggtgctccaagataatggggacattcacggcattaataacttgaaaggaaagcgggtcattacaagtccgacgtcaaacggcgcgcttgtcctgaaaaaatggaatgaaaaacacggcagtccttttgaaatcgcctatgccggccaaggttcaaacgatgcggccaatcagctgaaatccggccgcgccgatgcaacgatttcaacgccgtttgctgtcgattttcaaaacaaaacgagcgcgatcaaagaaaaaacggtcggcggggtgctgtcaaatgccaaagtgttctttatgtttaacaaaaatgaacaaacgctgagcgatgacattgataaagcgctcaaggaaatcattgatgacggcacgcttaaaaagctgagtgaaaagtggctcggcgcggattattcaagggagcaatattaagtgaaaaagagagggaccggcaatggaaaaagcgtttgatatcagtatgatcgcgtcctttgtgccgacattgctcgggtatttgcccgtcacgctgtatatattggcggtgtctttgctgttcggctttctattggggctgcttttggcgctgccccgcatctatcgcattcccgttttgaatcagtttgcgaagctgtatatctcttttttcagaggaacgcctatcatggtgcagctgttcattgtattttacggcattccggcgctcacggcgctcgccggaattgatacctctaaaatggaccctttgtatgcggccatcgccacgtatgcgctgagcagcgcggcaagagcggccgaaatcatcaggggaggtgtgaacagcgtcggccgcgggcaggcggaggcggcgttcagcatcgggctgaacagagggcagacattccggcgcatcattctgccgcaggcgctcgtgcaggcctttcccaacatcgggaatatggtgatcggtttcttaaaagatacatcactcgctttttcgatcggggtgatggatatgtcgggcagaggacagaccttgattacatcgagcaatcattctcttgaagtgtatatctcgctgtctgttctgtattacgcggccgcccttttatttgaatgtgtcttcagatgggccgaaaaacgaatcaagaaagatgagacgcgccttgtgacggtttttgacatgagtgcgcacggctgaaaaggagggagaacagtggagctggacattccgtttatcggcactgcgataaaacaaatgttgaaaaccgttccgcttacattggcgatgacgatcattccgattattgccggatttttcatagctctcggcaatatcacggtgcgtatattccgcatcaaatggctgctggcctgctcagcgttttacgtgtcttttttccgcagcaccccggcgattctccatattatgctgatttatttaggggttccgctgattgccgatcaattcagccgcgcgtttcatctcggctggtcagccaatcagattccggtcgccgtgtttgtcatcatggcactgtcattaacggcaggcgcttatatgacggaaattctccgatccgggatcatggccgtcgatacggggcaggcggaggcggcatattcaatcggtctgacgcggggccagttgattcggcgcgtaattctgccgcaggcgttcatgatatcgctgccgaacttcaccaatataggcatcggctttttgcataccacttccatcgcggcaattgttgcagtgcctgaaattacaggaacggcgacgattgcggcatccgataactatgcgtttctggaagcatttatcggggcggccgtgatttattggggattaacgctgattctcgaagctgtaaacagtctggcggaaaaaagagcggccagatatcaaggaggcgcattatgatcgaaatccgaaacattcagaaatattttggcagtcatcacgtgctaaaggggatcaatttaagtgtccggaaaggagaagtcgtgaccatcatcggcccgagcggttccgggaaaaccacttttctgcgctgccttaatttgcttgagcggccggatgagggcgccatttcgctgcacggtgaagtcattaactgcaaaaagcctgccaaaaaagacattctcagactgaggaaacagacagcgatggtttttcagcaatatcatttgttttcgcataaaacggcgattcaaaatgtcatggaaggcctgacggtcgcaaggaaaatgaaaaaaacagacgcgtacgccattgccgagcgggaactggccaaggtggggcttcaggataaactacacgcctatccgaatcaactgtcgggaggacaaaagcaacgggtcgggattgcccgggcgcttgccattcatcctgatgtgatgctgtttgatgaaccgaccgccgccctcgatccggagcttgtcggcgaggtgcttgaggtgatgcttaacattgtgcggaccggcgctaccatgatcattgtcacacatgagatggaattcgccagaagagtgtccgaccgaattgtgtttatggatgaaggagcaatcgtggaacaaggaacgcctgaggaagtttttcacaagacgaaaaaagaaagaacgaagaagttcctccgccgcgtgctgcctgattacggttatgacataaaagagcgcataaaggagcctgtcgtatgattcgtttaagcattttagatcaaagtgtcaccgcggaaaaccaaaccgcagaagaagccttgcggcaaacggtgaaattggctcaggaggccgaacaatacggatatgaccgtttctgggcggcggagcatcataacaatgaagagatagcgggatcagcgccggaaattgttctggggtatcttgccgcaagcacgaaaaaaatccgtctcgcatcaggcggggtgatgctgcagcattacagtccttataaagtggcggagcagttccgggttctgtccgcccttgctcccggccgtgtggcgctcggtgtcggcaaagcgcccggcggatttcagctgtcaaccgatgcgctgcagcgggagcttatccagcccgcccgtttgtttgaagaaaagcttgaggagctgactcatttcattcgaaatgattttccggactcgcaccgctacgcgtcattgcggccgacgccgcatactgagtatgcgcctgacatctttttgctcggcagcagcgcggaaagcgcgatatccgcggccaaactcggcatttccttcgttttcgcctatttcataaacggtgaagaggctgcgttagaaaaagcgcgccacgcctttgacgagcatctgccgaaaggatcgaaggcggaatttcaccttgcgccgatggtatttaccgcgcatacaaaagcagaagcggaaaaacacgtcgtatcgcgtgagtcggtcaaaatcattctcgaagacggcaaaaaggtgaatgtcggttcccgggaacaagcggaagcgtttctggaacaagtcacgcagccatataagctgatcacacaaaagacgggtgtgattgccgggacaaaagaagagaccgccgccgagctgagacgattatccgttcaatacagcattaccgattttgtgattttgtcgcctatcaaaaacgctgaggaaaaacgattgtcttaccggctgttaagcgaagcggtgcagccggccccacaattataggagggatgaacatgagtcatgaagtaaacgtagtggtctggagcaaacagggctgctcctattgcgatgaagtgaaaggatatttgcgggaaaaagccgttgcatacgaaacaattgatgtgacagaacgggacgaattgcgtgacgtgctgcagacgaagtacggcatccgtcatgtccccgtcgttgaaatcggcagcggtgacagccgtgtgtatcaggccgttactcaagtcggcattgatcatgtagaacgggcgcttgccgattacgaggggaaaaagggggagagaaaatgagccggacggatctaattcaattcggagccatgattcacggtgtcggcggcacaacggacggctggcgtcatcccgacgccgatccgacagcaagcacgaatgcggcgttttacaggcaaaaagcgcagactgctgaaagagggctgttcagctttgcttttattgcggacggcttgttcatttctgaaaagtccatcccgcatttcttaaatcggtttgagccgatcactattttatcggcgcttgccgcctctacaacccatcttggtttaatcggcacattttccacctcgttcactgagccgtttaccatcgcaagacagctgatgtctcttgaccatatcagcggcggccgggcgggctggaatctcgtcacctctccgcaggcgggagccgcgcgcaatcacagcaaagaaagtcttcccgaccacagccggcgctacgacatcgctcaagaacatgtggacgtggtgcgcggtctgtggaattcctgggaagaagatgccttcgtccgcaacaaagaaaccgggcagttttttgatcctgacaaactgcatcgcctatatcataaaggcgagtattttcaagtggagggcccgctgaatatcggccggtccaaacagggagagccggtcgttttccaagcggggtcttcagaaaccggccggtcgtttgccgcgcgtaatgccgatgcagtctttacgcactccaattcacttgaggaaacgaaagctttttatgatgatgtgaagaagcgggcggcggattacggccgcgacgcttccaagctgcggatctttccgggaatcagtccgattatagccggttcacaagaagaagcggaagcgaaatatcaggaattcgccgagctgataccgatagagaacgccattaaatatgtggccagattttttgacgattatgatttgagccgttttccgctggatgagccgtttcctgatttgggcgacgtcgggaaaaacgcgtttcaaagcacgacagaccgtatcaaaagagaggctaaagccaggaatcttacgctgcgtcaagtggcgcgcgaagccgcgtttccgcgaacgaactttatcgggacaccggaacgtgtggcatcattaattgaaacatggtttcagcgggaagcggcggacgggtttatcattcactctgacatcccgggcatgcttgaagcctttgtggatcaagtcataccgatccttcagaaaaaggggctgtaccgaaaaagctatccggcggatacattgcgggggaatctcgggttggatattccgatctgcaaaccaaatccgattttgagcagaaactaaatgtttctgctttttctgctgcttgccattcccgtcattacagccttttttaaaaaatatactgatttcgagatattattgttgcgaaaagaattttttgtaactataattattacagaactgatcagtataaaaaaacattcatatttcataataaatgtgtgtgtaatttgaaaacgaaagggctgtttacaatggcaaaagtactttatatcactgctcatcctcatgatgaaaagacatcttacagcatggcgacaggaaaagcgtttatcgattcttataaagaatcaaacccgaatgatgaggttgtacatatcgacctttacaaagagaacattcctcatatcgacgcggatgtattcagcggctggggaaaacttcaatccggcacaggatttgaagagctttctgaaaacgaaaaagcgaaagtcggccgtctgaacgagctgagcgatcaattcgcgtcagctgacaaatacgtattcgtcacaccgctttggaacttctcattcccgcctgttatgaaagcgtaccttgattctgtggctgtagccggaaaatcattcaaatatacagagcaaggcccgatcggcctgttgactgacaaaaaagcgctccacattcaggcgcgcggaggctattactctgaaggcccggcggctgacatggaaatgggccaccgttacatcggcatcatgatgaacttcttcggcgttccttcttttgacggtttaatcgttgaaggccataatgctgaaccgaataaagcacagcaaattaaagaagatgcgattgcccgcgcgaaagaagccggaaaatcattctgatcttaaaaaaaacctccccgccgtacggctgggaggttttttatattaaagggcaatcgtccgtttttgctcgctgcttttcatcgccgcttcaatgacacggatgacatcgatgccttcttttgccgtaacgggaagctgttttccgtttaagatgctgtccgccagcagtttgtagtacgtaaggtaagagccgttctcagaggggattgtttctgtatgccttttttcatccgctgcgattgtcagctctccgaagttgtcagggtcatcggcgccccagctgtcgtcaatcggcttttggccggctgaaagcgcctcttcctgtccgtcctttccgtatttgataaagcttgcattccgtccgtgaatctgatagcgcgggccgtttgccgcattcatagagccggattgaagaatgacctgaagtttgccgtaatggagcgcggccagaaaataatcgacggtttcactgttgtcccgctgtttcatcacatgtgccgtgacggattccggcattccgaaaagcaggagtgtctggtcaataatatgtgaaccgagatcatacagcgttcccgtggcgggtccgcttttttcgcgccatctttcttggacaaccggattgtacagatcgtagttgacttgatatgtatgaatgtcttgaagcgccccgtcccgaatcagcttttgtatcgttaaaaagtcattgtcccagcgccggttgtggtacacgctcagtaagacgcctttatcttcagccgttcttctcagttcctccgcttctgctgaagtcgccgtcatcggtttttccacgacggtgtgttttcccgccaggagacatttcatcgctgattcataatgcattccgctcggtgtcgtaacgatgacgagatcaatgtcaggatcaccggtaatgtcttcaatcgcgcgcacggcttcagcccccggcagatcacgtctgacctcatccgttctggaggtcatgacttttttgatctgataatcatcaaggacgtccaaaagcggcgcatgaaagactttacccgacaaaccatatcccaatatgccaacctgtatcgttttcaatgaatttccccctcttgatatgtgataacattatataccccgcgggtgtactggtaaaacttgtgtgttgaaaattttttacaccggattttcaagtctgtataatgaagataacgaagaaaaaaaccgaggtggaaaatggacaaacataccgagcatcaatcgttaaatcataaaagcgccaaggaaaaagaccagattctgaaccggctgaaacggattgaaggccaagtcaggggcattcagaatatggtggagaacgaacgatactgcgtggatattctcgtgcagatttcagccgtgcaggcggccatgcagaaagtcgcgtttcatctgctggaagatcacgcccatcactgcgtagccggcgccattgagagcggaaacggggagcaggcgattgccgagctgcttgatgttgtgaaaaaaatcgcaaaatcgtaaaataaaatgttttgaaataccctacaggggtatggtaacataaaaaagaaaaaacaagacgtggagggaatcatcatggaacaaaaaacactgcaagtggaaggcatgtcctgtcagcactgcgtaaaagcagtagagaccggagtgggagaactgaacggagtgacggcggttcaggtgaaattggaagccggacaggtggatgtgacgtttgatgagcacaaagtctccgtatcagatataaaagacgcaattgaagatcaagggtatgacgtcgtataaggtttatcgcgctgcgggaacgggcgcggttttcttttatcataattataccctcgtggggtttatgaagagagatgaggacattgagtgaaccgaaagaaatgaccattcaagtggggggcatgacatgcgccgcctgcgcttcaagaattgaaaaagggctgaaacggatggacggcgtcaatgacgcttccgtcaatcttgcgcttgagatctcaaatatttcctatcagcctgacaaaatcgaagctggcgccataaaggataaaattgaaaaactcggctatcacgtcgtgacggaaaaagccgattttcagattgaaggcatgacgtgcgccgcttgcgccaaccggattgaaaagcgcctgaacaaaacagagggcgttgtgagcgcaccggtgaatttcgccctggaaacagtcaccgttgaatacaatccgaaagaggtgacgccgaaagagctgaaagagaccgtggcaaaactcggctaccgattagacgggaagaaagcggttgatggagacggcggattatcccaaaaggagaaagagcagcgaaagcagctgatcaggctcatattttctgccgttctctcctttccgcttttatggtcgatggtcagccatttttcttttacttcttttatctggatgccggatatcctgatgaatccgtggctgcaatttgcgcttgccaccccggtgcagctcgtcatcggctggcctttttatacgggagcgtacaaggcgctgagaaacaaaagcgccaatatggatgttctcgttgcgctcggaacgacggccgcttacgcatacagcctgtacatgacgattgcgtctctcgggcgagacggacatgctgaggggctttattatgaaacgagcgccattttgctgactttgatattgcttggaaagcttttagagatgaaagcaaaaggccgctcatcagaagcgattaaaaagctaatgaagcttcaggcgaagacggcggcggttgagcgggacggcaaagtacaggtgattccgattgacgaggtccggacgggggatatcgtatacgtgaaacctggagaacgcgttcctgtcgatggcgaagtgattgaaggccattccgcgattgatgaatcgatgattacgggagagagcatgcctgtcgataagtctcccggaagcaccgtcacaggggcgacgatcaatgcaaacggctttctcaaaatcagagcggtgaatgtcgggaaagataccgcgcttgcacacattattaaaattgtggaagaagcccaaggatcaaaagcccccattcagcggctcgcggatcacatttccggcattttcgtcccgattgtgctggggctggccgtgctgacttttctcatttggtatgtatgggcggcgccgggacagttttctgaagcgatcggcaaattcatcgccgtgcttgtcattgcctgtccgtgcgcactggggctcgccactccgacgagcattatggcgggctccggccgtgcagctgaattcggcattctctttaaaggcggtgagcatttagaaaagacccagcgtctgacgacaatcgtactggataaaacaggaacggtgacaaacggcagaccggttctgacagatgccgtaccggcagagggaatgaacgaagaggaactcctgcggctggcggcggccgccgaaacgggatcagagcacccgctcggagaagccatcgtgtcaggagccgaaaaacgggggatttccatcccgaaactcacccggtttcaagcccggatcggttccggaatctatgcagaggctgacggcagaacgattctagccggatcaagacggctgatggaatcagagcatattgaacatgaagcgctgcttccgcaaatggcccgcttggaggcggaaggaaaaacggtgatgcttattgcggcagacggcaaagcggcggggcttatcgcagtcgctgataccattaaagaaacatctccggccgcggtgaaacgtctgaatgatatggggcttgacgtcatcatgatgaccggtgacaacaaaaagaccgcggaagccattgcaaaagccgcgggcatcggcagcgtgatcgccgaagtgcttcccgaacaaaaggcggcggaaatttcccggctgcaaaaagaaggccggcgcgtggcgatggtcggtgacggcatcaatgatgctccggcgctggctgtggccgatatcggaatggccatcggcaccggcaccgatatcgcaatggaagcggcggacattacgctgatccgcggagacctgaacggcattgccgacgccatcggcatgagccggctgactatgagaaacatcaagcagaatttaggatgggcattgggctacaacagcatcggcattccgattgcggcagccggctttctggctccgtgggtggcaggcgccgccatggcgttcagctcggtatcggtcgtgcttaatgctttgcgtttacagaaggtgaaaaaagacaaaatcggctgatgccggttttgtcttttttattgacactttattcaaagcctgcatataatagagaaaacacttatatgagtatatgctcatatatataaattcgtttacctgtattgatgttatgggaatcctattacggaaagtagggtgagtcgaaaatgaaagcagccaaaggtgaatttgtattagacggacttgattgcagcaactgtgcaaaaaaaatagaaaacggcgtaaaagccattgacggcatagacggctgtgctgtcaattttgcggcaagcaccatcacggtctcagccggcgggaaaaacgagcaatggatgaaagatgaagtcgcgaaaaaagtaaagtccattgatcctcatgtgaccgttcgttcgaagcacgaagacaaacccggtgaggatgaataccgcaaaaagctgcagctgatgttagtgagattggcggcgggcgccgttttggccgtcatcgcttacttcgcgcacacgggcgccgtccttgagtttctgctcttttttgcttcatatttgatcatcggcggcgatatcgtagccagagcgggaaaaaatattgtccgcggccaggtatttgatgagcattttctgatggcgcttgccacaatcggcgcatttatcattcatcaatatccggaaggcgtcgcggtcatgctgttctaccagatcggtgaattgtttcagggagcggccgtcagccgatccagaaaatcgatcagcgcgttattggacatccgtcctgagtacgccaatgtgaaaacggaaaacggcatggctgccgttcccccgcaggacgtcaaagtgggacaggtcatcatcgtgaatcccggagaacggattccgctggacggaaaggtgctgagcggttcctcgatggttgatacatccgctttaacgggcgaatccgtgccgagaaaagcggagccggggcaagaggtgatggccggatttatgaatcagaacggcgtgcttcatattgaaacctctaaagggtatgaagactctgccgtgtcaaaaatattgaatctggtcgaaaatgcggccggacgcaaagcgaaaacggaaaactttattacgaagtttgccaagtactatacaccggccgttgtcattgttgcggtgcttctcgcctttttaccgccgcttctcgtgccttcagccgcgctatccgactgggtgtaccgcgcgctgattttccttgtgatttcttgtccgtgcgcactcgtcgtctccattccgctcgggtttttcggcggtatcggggctgcgtctaaagcaggggtgctcgtgaaaggcagcaactatttagaagcgctcaatcaggtggcatacgccgtgtttgataaaacgggaaccttaacgaaaggcaatttcgccgttactgatatcaaaccggcggcaggatttacgaatgacagcctgcttcatgcagccgcgcttgcagaagtccattccaatcatccgattgcttcttccatccgcgaagcttacaatcaaccgctcgcggctgaggagattgaagaatatgaagaaatacccggacacggcattcgggtgaaaaccggcggatcaacgattttggccggaaatcaaaaactgctggcaaaagaacaaatcgcttccggcacagctgaaaataacggaaccgtcgtttatgtcgccgtggatcagcagtatgcgggggcaatcgtgatcgccgatgaaatcaaagaggacgccaaacaggccattgccaatttaaaagcgctcggcgtgaagcggacagtgatgctgacgggtgattcaaagcagaccggagaagctgtcggcctcgagctcggtattgatgacgtgtacacagagcttttgccgggtgacaaggtagaccgcgtcgaagaacttgaagcggcgctttcaccgaatgaaaaactgatgtttgtcggcgatgggattaatgatacgcctgtgcttgccagagctgacatcggagctgccatgggggctctcggttctgatgccgccgtcgaagcggccgatgtcgtcctgatgacagaccagccgtcaaaagcagccgaagccatccggattgcacgccgcacacgccggatcgtctggcagaacatcggatttgctttaggcgtaaaaatcatttttctcttgcttggcgcattcggattcgccaccatgtgggaagcggtcttttcagatgtaggcgtcacgctgatcgccgttgccaacgcgatgcgcgtcatgagagtgaaagcggaataattgtcaaagataattcgtttttcagggttttcttaaacaaggttgtcttggtaaaatagagaagcgggccatccggcatccgcttcttttttattttaaaaacaatgaggtgtctgagtgaaaaagaaacaatcgtctgcgaaatttgcggtgattctgacgttaatcgttgtcgttttatttgcggccatcgtaattattaacaaccaaacggaaaaagcgggcgaaacagtcgccgaacagccttccattaaaggacagcccgtgctcggcaaagacagcgcgcctgttacggtagttgaattcggagattacaaatgtccgtcatgcaaagtatttaacagcgatatctttccgaaaatcaaaaaagattttatcgataaaggcgacgtgaaattttcatttgtgaacgtcatgtaccacggaagcggctcgcgtctggcggctcttgcttcagaagaggtgtggaaggaagacccggcatcattctggactttccatgagaagctgtttgaagagcagccgtcaagcgaacaggaatgggtcacgcctgcattgcttgaaaaaacggtcaaaagcaccgcgaaaaaggttgatcctgacaagctgaaggaaaaccttgataaagaaaccttcgcaaaagagctgaaagctgacactgacctgaatgataaattaaacattacggcgacaccgacgatttatgtaaatgacaaggtgattaatgacttctctaaatatgatgagatttcaaaaacgattaagaaagagctgaaaaatgaaaaatagaatcgtgtttttatatgcttcttgggtgatagctcttgctgccatgctcgtcagcctttatttcagcgagatcagaaaattcataccgtgcgagctgtgctggtatcaaagaattctcatgtacccgcttgtcctgattttaggaatcgccaccttccagggtgacacgcgcgtgaaaaaatatgtgctgccgatggccgtcatcggcgcatttatatcgaccatgcattaccttgagcagaaggtgcccggtttcagcggcatcaagccgtgtgtctacggcgtgccttgctcatctgaatatattaactggttcggtttcattaccattcctttcttggcattgacggcatttattctcattattatctgcatgtgttttgtcaaaacggaacgcacggcaaaataaagagcctgctccatgggagcggctctttttctattatttgtaccaagctttgtttgtcgcaatctgtctgttatgggagctgtcccaaatatccacggaataggcataatcataattcatgacgcagcggatgccgctgccttgggcgtcatgctgaagtccgaagttatgggaaaactcgtgctgtgccgctttcgccgtgttggccgttccttgatcaaggttcacgctgaaagccgggccgctcggtttgccgttatatacatacgcgataccgccggcgtcaaaactcgattttgcggtaaaaccgacgacaaaatgataattttgatttctgaagctgctttggagattcgataaaatctgagaactgtttgagccggaagaattccaagcctgcacggcctgtacgacgaaatcaatgttgtgatcacggttaaaagcgacatccgcctgctccacgatctggacgattcgcgtttgccagtcgctgtatttggcgcggtattcagcgtccgccaccgccagcactctgaccttctgggagcccgtgctggctttagttgaggctttatcctgactgacattggcattgaatcgtttcgtgccggcctgcttgccgttctcatccagaatttttgtgtcaaccgtctgttcaacttggaccgggcctttcagatctttaaaatgatcggctttcggaagcgggtccgtatacaccgttttcgccggctccgcatgagtgtgcgaatgcgtatggctttcggctgacggcaggccgggaattaatccggcggccaataaaacaggaaaaacaagtgaactgattttcatctcataaccccctttttgttagagaaagtattcaatgaaacttccaataaaccttccattaaagtataaaataggaaaatattcttgctttcagccgttgcggatgaggttgtcccggatcaggaatcagaatctttcaaaaataaggttgattttaagagaaagcgattataaaatctaatggtcgtcagaaaatttaacaaataaaaaggagcatatggaatggcctgggagctgcttagtgtaatcggcatcattgcgtttgcggtcagcggagcgattgttgcgatggaagaggagtatgatattttaggcgtgtatatcttggggattgtaacggcgttcggcggcggagccatccgaaacctgctgatcggtgttccggtctccgccttgtgggagcaaggcgcgttttttcaaatcgctctcgcatcagttacgattgtctttttgtttccgaagctgctgttaaggcattggagtaaatggggcaacctatccgatgccatcgggctttcggcgtttgccatccaaggcgctttatatgccgtgaaaatgggccatccgctcagtgcggtgattgcggcagcggtcctgaccggcagcgggggcggcatcatacgggatttgctcgcgggcagaaagccgcttgtgctcaaggcggaaatttatgcagtctgggccgcgctcggagggttaatcgtgggcctcggctgggccggggatgccgccggtttgtatgtgctgtttcttgtgcttgtggcatgccgcatctgcagttatgtgttcaggtggcgcctgccgattcgttcctatcatatagaacagtaaaaaaaccgatttcacaaacgaaatcggtttttttgcataacggcttctgataaaaaaagacgcccgatatgataagaaaaagggtatttgaccataatgctgaataatatgttgcatatatgtttgtatgatgaaagccggacttgtcagcttgatgtcggaggtgccgctgatggcaaaacgtgataaagagtggaaagaagagcaggaaagaatcaattttgtcatgaaggaactggaacagaaacaaactcatcttgaagcctcatcgggcggattgaagcaggatattgtcggcctgagaaaaacgttttgggatgatgtcaccgtgaatatggatgatgcccacgaagcggctgagacatttttaagcattaaacagcaggcggaaatgctttcagaacgtgaacggacgcatcggcttcaataccggcagcttcaaaaaatccaaaagctgaaaacctctccttacttcggccgtgtcgattttacggaaaaaggggagtcctcttccgagcggatttatatcgggctgacttctttaatggatgaaaacaacgagcaatttctcatttatgattggcgcgcgcccatctcatctctttactatcaatattccccgggaaaagcccgctatgaagttccggaagaaacgatagagggagacatcacactgaagcggcagtttatcattaaaaacgggacgcttaaagcgatgtttaacacggatatgacgattggtgacgaaatgctgcaagaggtgctgagcggccattccggacagcatatgaaaaacatcgtgtcaaccatccaaaaagaacagaacgaaatcatccgggatgaaaaaagcaaatatctcatcgttcagggagccgccggaagcgggaaaacatccgcggcgcttcagcgggccgcttacttgctgtaccgcgggcgcggggtgcttgatgcccgtcagattgtattgttttccccgaacattttgttcaacagttatgtgtccgccgtattgccggaattgggagaagagaatatggagcaggccacctttcaggaatatatcatccgccggctcggacgaaagtttgattgtgaaagcccgtacgagcagcttgaatattgcctgactgaacaaaataaggacgcactttccgtaaggctcgcagccattgcttacaaagcgtcatcagcttttcaggccatgattgaccgctatgccgggtcgctttcggtctcgggcctgaaatgtaaacagatcagcttccggggagacatcctgatttcaaaagagcggattgaagcctatttttattcgcttgatcagcagctgccgattccgaacagagcggagctgacggcggaatggcttctcgcggaaatcagcgctctcgaaaaaaaggagcgtaagaaggaatgggtcttgcaggagagcgagctgcttgataaggaagactatgctgaggtttatcaaacactcaagaagcaggcggcagatgatgaacctgcatttgacgaccatcagcgcgaacagcgcctgcttggcgccattattgtcggcaaagcctttaaaccgattaagcaggccgtcagacggctcggctttctcgatataaaacggatgtatctccggctgttttcagactggggagctgatgaaaagcccgatcattgggagagcatcggcgctttgaccggaaacgcatttgcagaacggtcgcttccgtatgaagatgccgctccgtatctgtatttgcaggatctgttagaaggaaaaagaaaaaacacacaaatgaagcacgtcttcattgatgaagcgcaggattattccccatttcagctcacgtatattcaaaccatcttcccggcggcaaagatgacggtgctcggtgatgtcagccagtcgatttatgcccataccattacgggcccttcttccctcgccggctgctttcgcaatggtgcagaaaagtatgtcagcctgaagcggacttacagatcgacgcggcagattgttgaatttacgaaagcgctgctggctgacggcgatgacattgagccttttaaccggaacggggaaaaaccgcgtgttttgcggacggatacagaaaatgcgcggcgggaacaattggcggatacaatccgggagctcagacaaaaaggctgggagacggtcgccgtcatctgcaaaacggccgcggaagccaaaaaagtgtttcaggcggtcagcgccgagagcggtgtccgtttaatcaataaagaaaaccagccttttcaaaaaggggtatgcgtcattcccgtttatttggcaaaaggcattgagtttgacgccgtcatcgccgctgacgcctctgctgcccagtacaatagcgaacatgaccgtaagctgttatatacggcctgtacgcgggcgatgcatcatttgaccgtattgtctccgggagaaccctctccttttataaaagaagtgcccgccggcttattcgtataagccctttgctgagtgcaaagggctttttatcattagtaatcttaatcgttgtcatcatgattatatattttacttacatacaaactttcggtaaagtttcaattagaatattattttgacaattcctatagaaataacgtacgttacgtttaattccttgtgaggtggatatcgttgcaacttcaggtcatgaacagtccgtttaatcaggagcaggcagagctccttaaccgccttctgccgaccttgacagaatcacagaaaatctggctgagcggctatttggctgcggcccggtccgaatccggtgaaacagccgcgcccgctgctcaggctcctgctgaaagcccggcagtctcgaaagaagtgaccgtattatacggatcgcaaacgggaaatgcggaaggtcttgcgaaacagacggtaaagacgcttgaggaacggggattccaggtcaccgtcgcgtcgatgaacgattttaagccgaataatctgaaaaaagtaaacaatttactgatcgtggtgagcacacacggagaaggcgatccgccggataacgcgctggcctttcatgactttcttcacggcagacgcgcgccgaagcttgaagagctccgttactccgttttggcgctcggggacagctcgtatgaatttttctgccagaccggcaaagagtttgacgagcgtcttcaagagctcggcggcacccagcttgcgccgcgggttgattgcgatcttgattatgatgagccgttttcggaatggcttgaagcggtcatcggcggtttgaacgaaggagcgggaaatcaaacagccgaagcgcctgccgagacgcccgctctcggtgaatccgtttattccagaacgaacccgtttcgggcggaggttcttgagaacatcaatctgaacggacgcggttcaaataaagaaacacgtcatctcgagctttcgcttgaagggtcgggcctcgcgtatcagcccggagacagcctcggcatctatccggaaaatgatccggcgctcgttgatgagctgatcaatgagctgaaatggaatccggaacaggaagtggcggtgaataaacaaggagagcgccgtccgctgaaagacgcgcttacttctcattttgaaattaccgtcttaacaaagccgcttttgcaaaaggccgcacagtttatggctgatcaaaagctgagtgaacttctggccgaaggaaacgaagagcagctgaaagcatacaccaacggccgtgatctgcttgatctcgtccgggatttcggtccgtgggaagcttccgcggaagactttctttcgatcctgcgtaaaatgccggcccggctctattcgatcgcaagcagtttagaagcgaatccggaagaggtgcatctgacaatcggagcggtcagatatgacgcgcacggcagagaacgcaaaggcgtctgcagcattctttgtgcggaaagactccagccgggagatacgcttccgatttacattcagcacaaccaaaacttcaagctgccggaaaatccggatacaccgatcattatggtcgggccggggacaggcatcgcaccgttccgttcctttatgcaggagcgtgaagaaaccggagctgaagggaaaacatggctgtttttcggggatcagcactttgtcactgattttctgtaccagacggaatggcaaaaatggctgcaaaacggtgttcttacaaaaatggacgtcgctttttcccgggattcggaggaaaaagtatatgtgcagcaccgcatgaaagaacaaagcaaagagctgtatgaatggctgcagcagggagccgccgtatacatctgcggtgatgaacagcatatggcgcatgacgtgcaccaggcgcttctcgatatcattcaggaagaaggcggcatgagccgtgaaaaagcggaaagcttcctggcagacatgcagcagaaaaaacgctatcagcgtgacgtatattgattttggtttgaaaggagcttattcagcatggtgaacaacattttaaaagcgccggaaggccctccaagtgatgttgaggaaattaaagaaaaaagcgattatttgcgcggcacattgaaagaagtcatgctcgaccggatttcagccggcatcccggacgatgacaaccggctgatgaagcatcacggaagctacttgcaggatgaccgcgatctccgtaatgaacgtcaaaaacaaaagcttgaaccggcttatcagttcatgctgcgtgtccggatgccaggcggcgtgtcaactccggaacaatggcttgtcatggatgaactggcgcaaaaatacggaaacaatacattgaagctgacaacgcgtgaaacgttccaaatgcacggaattttaaaatggaacatgaaaaaaacgattcagaaaatcaatgcggcgctgctcgataccattgcggcctgcggagatgtcaaccgaaacgtcatgtgcgcttcaaatccgcaccagtctgaaattcatgcggaagtatacgaatggtcgaagaaattgagcgatgaccttcttccgcgcacgagagcctatcatgaaatctggcttgatgaggaacgtgtggcgggaactcctgacacggaaacggaaccgatgtacgggccgctgtatttgccgaggaaattcaaaatcggaatcgccgtgcctccgtccaatgatatcgatgtcttttctcaagatctcggcttcattgccatcgtggaggaaggccgtcttatcgggttcaacgtggcaatcggcggcggtatgggaatgacgcacggcgatacggccacttatccgcagctttcaaaagtcatcggcttctgcaaaccggagcagctgtatgatgtagcggaaaaaaccattacgattcagcgcgattacggaaaccgttccgtcagaaagaatgccagattcaagtacaccgttgaccgtctcgggctggaaaacgtaaaagccgagctggaaaaccgcctcggctggcagctggatgaagcgaaaccttatcattttgaccataacggcgaccgttacggatgggtgaagggcgtaaaagggaaatggcactttacgatgttcatcgaaggcggccgcgtcacggactatgagaattataagctgatgacgggattgcgtgaaatcgccaaagtccatacgggagatttccgtctcacctctaatcaaaacctgattatcggcaatgtctcgagccagaaaaagaaacaaatcagcgcattaatcgaacaatacggtctgacagacggctggcagcattccgccctccgccgcagttcaatggcttgcgtcgcgcttccgacatgcgggctcgccatggccgaagccgagcggtatctgccgaagctgattgataagattgaagacattgttgacgaaaacgggctccgggatgaagaaatcaccatccgtatgaccgggtgcccgaatggctgcgcccgccatgcactcggcgaaatcggatttatcggaaaggcgcccggaaaatataatatgtatttaggagcggcgtttgacggcagccgtttgagcaaaatgtaccgggaaaatatcggtgaagaggaaattctgaatgagcttcgcaccattctcccgcgctacgcgaaagagcgtgaggaaggcgaacacttcggcgatttcgtcatccgcgccggcatcattaaagcgacgacagacggcacgaattttcacgaataagatgagctcttaaaaccaaggatagagacacactggcggtgcgttctctatcctttactaagcagcataaacgctgctccgcgtcatgaaacagatgacgcagcttgcgaaaaagcctgttttcagagaaaacaggctttttctttttccggaaaaaatgtagctgaaggcaaaaaaagttcgccgtgagcgcgttatgagaaattttaaataaaaacgggtaaaataaaaggagaatggttgcgtgcggaaaatatattgaatctgcccgatcatcggctccggcctttgacaagggcagagaacaggcaataatgatatgatgcagcagatgaaggaggtcagctttggacatatttttagtcgtactcgtacttttaaccattatcgcgatctcaaatatcgtaaatcggtttgtcccctttatcccggtgcctctgattcaggtggcgctcggtatcattgcggcgtcatttccgcaggggcttcattttgaactgaatactgaattgttttttgttttgtttatcgcgccgctgctttttaacgatggaaaacggacgccgcgtgcggaactttggaatttaagagcgccgattctgctgcttgcgctcgggcttgtgtttgccacggtgattgtcggcggttacacgattcattggatgattccgagcattccgctggccgccgcgttcgggctggcggcgattctgtcaccgactgatgttgtcgcggtcagcgcgctgtcagggcgtgtgaagatgccaaaaggcattctgcgtctccttgaaggagaagggctgatgaatgacgcatccggcctggtcgcttttaaatttgcgattgcggctgccgtgacgggcgcattttcgctggcgcaagccgcgttcagtttcgttctgatttcagccggcggtttactcagcggtgtcgtcatttcttttttgattatccgtttccggctgtttatgcggcgcctcggcatgcaggatgtcacgatgcatatgctgattcaaattctgacgccgttcgtcatctatctcgcggctgaagaaatcggcgtttccggcattttagcggttgtggccggcggcatcacgcatgcggtggagcaggaccgtcttgaatcaacgatggtcaaactgcaaatcgtctcttcaagtacgtggaatattattttgttcattctgaacggtcttgttttcgttattttaggtgcgcaaataccggatgtggtttccgtcatctttaatgataccgcgtttaacaatatgatggtcatcgggtacattatcgtcattacgctgacgttaatgattctcaggtttttgtgggtgctgtttttttggaacggcaagtggttttttaacaaggatcagagcatttataaacccggcctgcgctcgaccctgctgatttcggtttcaggcgtcaggggagcggtcacgcttgcgggttccttttccattccttacgtgctctctgacggctcaccgtttcctgaacggaatttgattctctttttagccgcgggcgttattttgtgcacattggtgctggcgacaatcgttctgccgattttgacagataagccggaagacaatgtgaaagaaaagaaagtcaaattgctgacagcgagacggaagctgataaaggctgccttaaccgccattaaagaaaatatgaatgagtcaaacaaaacggcttcttttgcggtcattgccgaatacaatgagaaaatgaaaaatctcaggtttcagcagttcaccgtcaaaaaccgcacgaaaaaagatgagcggaaagtccgcgcccaagggattcaggcagaacaggaagaattgctgcggctgattgagcggggcgacataccggaagaaacggctgacagccttcaggaacggtttgatgaactggaagtgctttatacgaacccgtttaaagtcggcttatctaagaaaaagctgaaacgcctgatgtactggatctttttcggcgaacataaaaaaccggaaatgtcgattttaaatgaagaaggcctcattcgctccacaagggttaaaacggcaaaagcggccattgaaagcctgaaaaaacacatgactgaagaaaataaagatgtgacgcttgccgtcatttccttttacaatcacttgattttcaggctggggcactcgtatcacgaacagagtccgagtcgccgttttgaaaatcaaaaactcgaaatcaaactgcgggccgtgcaggccatccgcaacgaaatccaaacattattcgaagagcgggaaatttcccgcgacatgtcgcatgagcttcgccaatacatcaatgatgtggaagcggccatgcttgacggagatgaataaaaaaagtccggcatctgttcgccggacttttttagattacggacgatggaattcgacgtgatcgccgtcgcggtcaaaccagcctctgaaggcccagttgatccagccgccatctcctttgttggtgaagcttccgtcttcaaacacccaaatgccgtacgtgatgccgtcataaacggcggaaccgtaaaactgaacgccgttaaaatgatcttcatattcctggcttaaattaaacaccatgacattatatttttgtccggaagcgtagaatgaagattccattaagtttttgacgaagccgtcacggttttgcgccgacttaatcgcgtcagcaatcgaattgccgatgccgagcaggtcaacgtcaatgtttaatccgacatcttttgctgagacatctgatgtttgctgagccatgttttgaggggccgggttttcttttgcggatacaaaggacagaggagtcagagacaaagcggcgccaagggcaacggacatcgggatacgcatacgtttcatatgatttcctccttcaattgtgtggtggctacagtagcgatttacccggacagttacctgattaaccgtaatttttgaaaaataggaaaataataacgtcagtggtgcttgggcactaaagatggtttttgtgataacgatgagcgtataattggtttcttacggcggaaatgtgagataataataaccgtttacataatgactagaaaggatggttcaacgtggcaaaaagcttaaaagatactgtaaagcttcataatggcgttgaaatgccgtggttcggccttggcgtcttcaaggtggaaaacggaagcgtagcggcggactccgtcgaagcggcaatcagaaacggctaccgcagcattgatacggcggctatttataaaaatgaagagggtgtcggcgaaggcatcagagctgcgggcgttgccagagaagagctgttcatcacgtcaaaagtgtggaatgaagatcaaggatacgaaacgacacttgacgcgtttgagaaaagccttgagcgcctcggcctcgattacctcgacctttacctgattcactggccgggcaaggataaatataaagacacatggcgcgctcttgaaaagctgtacaaggacggcaaaatccgcgccatcggcgtcagcaacttccaagtgcatcatttagaagaactgctgaaagatgctgaaatcaagccgatggtcaaccagattgaattccacccgcgcctgactcaaaaagaagtaagagatttctgcaaagcgcagggcattcaagtggaagcgtggtctccattgatgcagggacagctcctcgataacgaagtgctgtcacaaattgcggaaaaacataacaaatcggttgctcaagtgattttgcgctgggatcttcagaacgaagtcgttaccattccgaaatcgattaaagagcaccgcatcatagaaaatgccgatatttttgatttcgaactgtcacaggaagaaatggaaaagatcagcgcattgaacaaagacgagcgtgtcggcccgaatccggacgagcttctgttctaagaaaaaacagccctttacggggctgtttttctttacataaatgtctgtgtctgacgttttacgctgaacctgtatgcggctattaataacagggcggcggcgaaggctcccaaaatgatgatgttcagcgtcaggctttggagcgtgcggccgtgctgcaattgatcgaccgtatcaagcacccagcgctgaggcagaaattcggcgattgtctgcactgttttcggcataatattgcccggaaaaaagcagccggcgagcaagcatgtcggtacaacgatcaagttcaaaagcgccgatgccgaagagctgctgttggaaaaaccgacggcaataaaggcgatcccgattgcgcttaatgcaaacagcatcatcaggacgaacagctgccacagcgggaatgacggatgaatatgaaaagcggcgcccataaagagaacggcgaatataatttggacggccatgataatgatattcactgccgcattcgccaatacatactgctttgacgtgatcggcgttgacagaagcctgtagtacgtcctgttttctctctctttaatcatcagttccgtcaggttgccggcggaatagagcataatgataatgagatacccgatgactgagtaagtcatttctttatggttcgaagtatctttcaaaacagcggactccgtttgaatcggagaatgcttgaaatcggcgtacatcgcctgaaaggctttctcgtctccgccggaagatttgccgattgaggcggcgctgttcatataattgtacaaataagagctgacatatccggtgacctgggcgcccttcagcgaggtcatgccgatgtgagacggtttcccgtcttttacgctttgggagaagcctttttcaaacgtaatgagcgcctccatttttcctgaagcgatctttgatgaggcggacgcatccgtttcctccgaaatcttcacatgatccagtccttttaaaaacgtgaccgtatcctgtgccacttctccgccgtcctgatcgagaatgccgatattgagcgtttcggctccgccgttggcattggtcatgaaggagaggaagacgccgatcagcggagccccgatataaagaatgagctgttttttgctttttgtaattcctttgagagtgtgtgcaaacagccaccagaagtttttcatattacagtccctcccgtctttgaaacgtaaatgcggcgatcagcaaaaagagtgccgccaatgctgtatttaaaccgagtgcaggccatgccgctgatacatcatttgcgtaaatgatgttgttaatcgccttattgatccaggataagggcgacagggcggaaatccccctccttcatatttgtaataggcgccgccgataatggacatcacctgcacgatgatgacggtgattaatctggcgctttcgggttttctggtcaaatagctcaggctgagcccgaagctgacggccaaaagaatttcagaaacgagaatcaacagcacaagtcccatgtggctgccccagttcgctttcaagataaatttgctgaaggcgacaacggcaagaatcgtcagaacattcacagccaaaatgccgagcatctttccaagaaagatatcgcttttccggagcggggcggcgatcaggcgatccgcggtgtgccgtattctttccccgcggaataaggagcttgcaaaaatcgaggcgtacagcccgatcatcgtcgtcatggatatcgcgtaaaaatctttcgccttcggttcttttgctttgtgtaaagacgtctgcttcatataatcgcttttgatttgtccggcggaaggtggcttatgcgccttgtaagcggcggcgcctgctttgtattgattggtaaaagcggtcagcatgccttggacgatcgtgccgttgatgccgctccggtcatttgtatagacttgaaaaccggtgttttttacagtgacgaaagcatccgcctgattttcacgaacctcgtttttgccttttgcctccgtgtccgctttttgaaaatagacatgctcttttttggcgtttttcataaactcagtaaagtaatgagaaagtgtcccgtttgattggtccgtatatacgaccttgatgttcccgaccgtcacctctgaatcaaaggcgtttgataatgccgcggtaaaaatcagcatgaagacgatcggaaaagcaagcatgaaaataaaagtccgtctgtcgcggaaactgattttgatttctttcccggcgatgtgcagaatattcatttgcaatcctcctttcaatagggtcagtcgcgcagacttctgcctgtcagcgtgagaaataccgtttctaagtcaggtgcctgttcctgcaaggagcggatttcaatgcctttgtccatgaagtaccggatcaggcggtttaaattgttgacccctgtgtcagagctgattttcacgctgttttcttccagtgcggcggctctgacgccgggcagctcctgaatatcgccgaggctgatgccgtttccggatgacagctcaatcacgacgtccttcgtgtcggtaatgatggaggtcagctgttcttttgtgccttcggcgatgacttttccgtggtcgatgatggcgatgcgtgtgcatatttcttccacttcctccatgtagtggctcgtgtaaatgatcgtgcagcccatttcattgagctttttcactgattgcagaatataatttcttgattgcggatcaatgccgaccgtcggttcatccatgatgatcagtttcggccggtgggcaagggcgcaggcgatattaagccggcgtttcattcccccggaaaaatgcttcggcaaatatttgtgtttatcgctcaagccgacgaatgtcagggcttcctcgacccgttctttcagagccgcccctctcaggccgtacagacctgcgaagaacttcacattttcataggcgtttaattcctcgtaaatcgcgaggtcctgagggacgatgccgatattcattttcgttgctttgctatatttgaaaatatcttttccgagaaacagaatgtctccgcctgaaggttttaaaagacctgagatcatattgatcgtcgtgctttttccggctccgtttgcgccgagaaacccgaaaatctcaccttcttttacggcaagcgacatctggtcaacggcggcataatcaccgaatttcttactcagctgtttgagctccaaaatgttcatgtttccacctctatgtcttatgatgctcttattataaaaaaaagaatgaacggccgttagtgcagctgttcattcctttgacatgagaatcttcatatttttcacatgaaaacattcacttattcaaccggaagcaatgtcgtgacggaaaaaccggccgtgccgtcaaaaataacggttccgtgcaggacggccgcccgttcttccataccgagcatgccgaggccttttttaaagcggacggcgccgtttccgttatctttcacttccgctttcacggctttattcagcacatggatatcaatgaaaatctgcgtggcatcggcgtatttcatcgcattggttaaagcttcggttacgttttcctgaatgactctccaatgcatttgcgtcagcctgtccaaatcgccttgatgcgtaaacggaaccggcatcccgtttttggccgaaaattcatcaataaacgttcttaatctgtgaatgcccatttgttcagcgggcggtttcatatttttcagcgttatgcggatatcctctatgccctctttggaaatggtaatggcgttttggagcagttcagccgctttgtccggatgggagccgagcatccgcttcgccgcttccatctgaatgagcgcgccggtcatcgaatggccgattttgtcatggatggcttgggacaatctgtttctttcctcgagtttgccggtgtactccgattgtttgatatattctgtgctgctgtgcagctgtttcgtcagtttttcaatgcttgagcgcatgctgtccgactgttcttcatatttcttcagccgattgccggaccgggcggccaaaacgaaaatcgccagacagaacaaggttatgacgatataagtcggaaggtcgccgtacgggataaataaaaacggcaaaaacacgagcaggcagaacacatagcggtgaaccggatattcggcaagaaccgcaaaaatggcgggcggcaaaagaaacagaaacgccggatggcctaaggcggaaagccaagcggtcaatgccagcgtcatgagggtgatcccgcgcctccaagcgggcggcctgatcatgcagaccgcgatgcccaaagacagataaagcagcagaaataagacggcgtacggcgtgtaagggcggtctaccgatacgaacaaaaaagccgtataaaaaatagcgatcagtctgctcatcagcatccaaaaatccataccgttcaacgcccgttatccaccttcccggtgatataaaaaatggcgatctgcgttctgtgctcaagccccgttttccctaaaatagatgaaatataattggccgtcgtcccttcagaaatgaaaagctgttttgaaatttccctgttcgagaatcctttcgcaataagcgacatgatgctgagctctctttcagtaaactggctttcatcaatctgatgcgcggcttccgccggccggaaaaggctgtcttttattttgtccagcacggtgtcctgaagaatgctgtgcccgttgaaaacgcttttgatcgcatcgcggatccgttccggttcggtgttttttaataaatatcctttcgcgccgtttttaattgcttctaaaatatactcatcgtcgtcaaatgtcgtcaggatcatcggcttcgtatccgtttcctcagcgatccgttttgcggcttcgacgccgttcatcaccggcatgcggacgtccagcaaggcgatatcgacggggttgtgcttacaatactctgccgcctcgagtccgttttccaacgttgctgatacagtaaattcctcatatgtatgcaaaatgattttcattccttctctgatgaaagaattatcatccgcgataatgacattaatcttcatagccgcaccctttgtgtgtttttgtttcattatataccatccgattttaaatcaaaaagcctcccggcgaaaggtgcgcggaaggcagatcggtcaagcgggctttttcaattggatgaaaaacagcatcagaaaagaaatgatcacaatacagatcacccacacccaggcgagtgtttcattgccggagtccatcgcgacgtaaatcgccgtcggcagcgtttgggtgacgccgggaatatttcccgcaaacattaaagtcgccccgaattcacctagcgcccttgcaatactgagaatgcttccggtcaagagggagggaaaggcaagcgggacggaaatacgggtgaacacctgccacctgccggctccgtctactttcgccgctccctcgatgtcagcatcaaccgcggcgaagccggttttagcggactgatacataagcgggaaggcgacaatggccgaagcgatcaccgcggccgaccacgtgaaaatgacgggctggtgaaaaatccgctcaatcgcccggccgataaagctgtgtttcccgaaaatgataatgagaatgaagccgacaacggtaggcggaagaacgagcgggagcataaacagggtctccacagccgtttttccgggaaatcgcgctttcgccatccaggcgccggcaagcgttccgagaatgatgacggcgatgcccgacgccaaagccacctcaaatgacagtacgacgggagtgaaaaactccgaagccgtaatgttacttggcagtaaatccatatttcttaaacactttcatcgcttcatctgactgcagatactgataaaacgcttctgcttctttacggtgctttgtatccttgacgatgccgacaggatacacgatcggatcgtgcgttttcgccggtgcttcatcggtgattttcacctttttcgaaatcagcgcgtctgttttatagacaagcccggcatcgacatttccggtttcaacataagaaagcacctggcggacgtcttttgcatagacggctttatcttttaccttgtcccacagggataatgccgtcagtgactgtttggcgtattgtccggccggaacggattcaggcgtgccgagcgcgattttttccgtgctgtcttttttcaggtcattcagatgtgtcaggtgtgcgctgtttttctcaggcacgatcatgacgagatcatttttcaaaagatccgtgctgtcctttttgtcgatatctccgtcatgaacgagcttttcgaatttatcttcggctgccgagaagaataaatcagctcccgcgccttgtgaaatttgtttttgcaatgtgcctgatgatccgaagttgtcttgaatggttacgtttgaatgtgatttttcgtagttggtctggatttcttcaagtgcatcctgagcgctggctgctgcagaaacggtcagcgtgacgttttcgttttgtccgcctttggacgattgtccggatgagcagcccgcagttgcgaggaaaacggccatagccgcagttgtgagtagtgtcgctttctttttcaacattgtgcaccccttatagctaaatatcattagatcaaactaattataacgcaattgtacgtgatggtgcggttttttttcaatatctgaacagttataataaaaacggagcgtgataatatgacagaagccacttcctatacaatagaagaagttgcgggccttttgaaggtctccaaactgacagtatatgatttgataaaaaaaggactcattccggcgtacagggtcggaagacagatgagggtcgatgaagaggacttaaaacaatataaagcaaacatgagaatgtcaaaaaagccatccgcagcagaagcgcctgacccgtcacgcgggcgggagccggaaaaaaggcagtctgttatcatcagcgggcaggatgtgtcgatggacctcctcagcaaacagctggaacaaacaatacaggcggctccgctccgcaagtacagcggcagtttgaacagcctgatcgagatgtaccgcggggcttgtgacatcgtcagtctgcatttatacgatggggagacggggcagtataacatcccgtatgtgaagcgcattctttcaggggagccgtttgcgctttttcatgtcgtgctgcggcaggccggattatatgtgaaaaagggcaatccgctgaacattcagggctttcaggacatgagccgaaaggatgtccgcatcgtcaatcgcgaaaaaggatcaggcgcgagggtgctgctggatgaacagctcagatcattcggcatcacgccgtctgatgtcgccggatatcatgacattgtcacggatcatctgtcagcggcttcacaagtatcaagcggaaaggcggatatcggagtcgggtcgctgcatgcggcgcatatggcaggcacggactttatcccggtgatcagtgagcagtacgatgtggtcgtcttaaaacaaaaccgggagcttgttcaaagcgtgcgggacattcttaattctgaggaattcaagtctcagctttctcaattatccggatatgatacgaaaatgacaggacggctcatatatgaaacatgaaaaatccctccatataacggagggatttttttattgcttataaaaccgcagcaggtcgccgtttaatattttatcggaaagcatcagctcttgttccgctttttctttctcatcgctgcacgcgctcatgtcagaaagcggttcacccgttttacggctgtaacacgtatttttcgtataaatatggtcatccgtgataaagctgccgtttctcagcaccgcaaacggagtccgctctccggaaaacagatcattgccgaactgaatgctgcctttcgtttcaatgccgagcaggtgaagcagcgtcggccttacatcaacctgtcccgcggccgaagcaatcgtttccggcgcacggtcggtcaccccgggaatatgaatgataaacggcacgcgctgaagctgaaccgtatcaaacggagtgatttcctctttccctaagaattcggcaagtccttgattatgggcttcggatataccgtaatgatctcccatcaggacgatcatcgcgttgtcatacagcccttcttttttcagcttcttgaaaaagtgtttcagagcctcatcttcatagcggaccgtcgtcacatagcggtttaataactcgctgcttgtgtccggttcctcaatgagctgatcctgttgatcaatttcaaaagggaaatggttggtcaaagtcagcaggcttgcgtaaaacggctgcggaagcttctttaatttttccgctgactgttcgagaaactccttatccttcaggccccagcctgttgaattttcctgtgtcaccttaaattcatccgcgtcgaaaaaacggtcgattccgaatgccccgtacatctcatcccggttccaaaaggctttatgattggcatgcagaacggctgaatagtattgacggtcttttaacatatggtacatcgtattgaaccggtggccgctttttgtgaaaaaaacggcgccgcttgaagacggatacagcgaattcgcagtaatgaattctgaatctgatgtttttccctgttcagtctgctgataaaaatgagtgaagtcataacttttttttcgcagtttgtttaaaaacggggtaatctcccgtccgctgacccgctcatccattacaaaacgctgtgttgattcgagcgtaacaaagatcacattgcgcccctttgcaagcccgaattttgaatcggacggcctgctgtagccggcttgagtgtaattcgcgaccgccgcaaggctgtcttcatcggcaaacgctttagcccctgcattcagcgtctgcgaaatggtgtcatacaaatgaaagtggaacaggccgattccttttacgagcgcttcacgatcaaaagggtgcttgaacagcttcggctgctcggcctcagacagcgcaaggttgcacagcatgaggccggctgatgcccacgcatacgctttaacggtacgggcgcccgcttttcctttatcggctttatgcctttttccaagataaaacaaaatcgcaatatccaaaaataaagcgatataaagcgggtgaaacagctcttggacgctgcttcccatatcacccatattgcttgcctgaaacaaaaccggtatggtgataaaatcaatataaaacccgtaaaacaccgtattcgcgattaaaattcccgtcagcatcacatttgccgaaagcagaaagatccgctgttttttttccgtcagcaagagggcgatgccgaacagcggcacaatgaagctcagcggattaataaggagcagacattcctcaagaaccgaattgttctgcagaccgaaaccgagcttatacacggcataggttttcatccacatgaacaggatggacaggcataaaaaccgatgattgctgaaaaaggttttcttcatatgtatgactcctcaccctaaaagcgaaaagacgctttttgtttaagagatgcggccgtgaaccagttcgtataaataatagcaggatacaatcgttaagccggccagcacaagctgctccgaaaagctccccgttctcatataaaggggaagacggaagcggatggcggacggaaacagcagtttaatgccgttgacggtccatgcgtcaagtacaagatggcttgccattccgatcatcagtccggcggaaatgctcggattcggaatataggttgccgtaatgaaaaacataataagcataaacagcaggctgtgtgtaaacgttctgtgcccgaacaccgtgcttacgactttggacagaacgggcagcgtcctgccgattttgcttttcgtatggcatatgtcgggaatcagcgccccgagggcacccgctgaggtcataaggaccggatcatacccgtaataatacgcaattgcggaacaagaagcgatgcctcccatgatgtgtgtttttcctgtcatttttcgcttctcctttttatttttgccaaaatcccctgaattacaaatatatcaagagaatgcatgtttgatcaacaaactttacctgttccgccaaaaggaaggagacgcggattccgcatattctgccgcggaaaaagacacattataggtgtacctatatttgataaagaggtgatacagatggctttctttaacaaagaaaaaggaaaaaacagcgataaaaacaaaaacgtcattcaaggcgcgcttgacgacgccagtgcagctctgaaagacgatccgcttcaagaagctgttcaaaagaaaaaaaacaaccgctgaccatataagacgggtagggcgaacgctctatccgttttccatctaatatttccctttgacagatctttttatctctgataacctctgagtagaattgaatgataaaaatcctcactctttctcggtgaggtagaggttgcgcttgatgatgagtcgcacatgccaggctgataaggggccgcaaaacatgtgttaaaggcatcagcgccgaagtgtaaagaaagccgatccttctttatgctgggactgtatctgaataagtgcaggactgccgcgtgctttttcgcggagggctatccggagatcaagggtgtgtgtgtttctttaagcatggacttttgttcaggctttttttgcgtgtaaatatggtctcggggtctggtccgtacgaatgaacaaccaggaggtacaggaatggaacagacgaaaaaatggggtttttggttattaacggcgtttgtcgtaggaaatatggtaggctcgggcatcttttcgctcccgagtacgctcgcaaaaatcgcgagcccgttcggcgccacatcggcatggcttttaacgggagccggtgtgttaatgatcgcgctggtcttcggccacttatccatccgcaagcctgagctgacggcggggccgcaaagctatgcgcgtgcgctgttcagcgatcggaaaaaagggaatgctgcgggcttcacgatggtgtggggctactgggtggcgagctggatcagcaacgtggcgatcatcacgagccttgccggatatttaacatcatttttcccgattttaacggataagcgtgaaatgttttcgatcggcggtcaggcggttacgctcggccagctgctgacgtttgccgtatgtacggttttattatggggcactcacacgatcctcgtcaccagcattaacggtgcgagtaaattaaatttcgtcacgacgttttcaaaagtattaggatttatcttctttatcattgcaggtttgtttgtatttcaaacgtcgtttttcgatcatttttattttcctgttcaaacaggtcctcacacggttgagggaatcggcggacagatccacaatgcggcgatttcaacattatgggcgttcgtcggaattgaatcggcagtcattttatccgggcgcgcccgttcgcagcgcgacgtgaaacgcgccaccattaccggattattgatcgcgcttggcatctatatcatcgtgacattgattacgatgggcgtgcttccgcatggtaagcttgtcggctcggaaaaaccgtttgttgacgtattgtacgcgatcgtcggcagcgcgggaagcgtcatcatggcgattctggcaattttgtgtctgttcggaacgatgctcggctggattcttctcggttctgaagttccgtatcaagcggcgaaatcaggagactttcccgctgcttttgcaaaaacgaataaacagggaagcccggttgtgtcgttaatcgtaacgaacgtaatgtcacagatctttatcttttcggttatttcccggacgatcagtgacgcgtttacgtttttaacgacggcggcgacgctcgcttatctgattccgtatctcgtgtcagcgttttacagcctgaagctcatttttacgggtgaaacgtatgacgagataaagggttcaagagtaagagacggtatcatcgccatccttgcctgcatttattctttttacgtcattattaccggaacggccgatttaacgacctttattctcggtatcgggctgtttttcgtcggtttgctgttatatcctttcgtctcaaagaaatttgcaaacaacagaccatcggtatgacaaaaagacatctcacgtctgtgagatgtctttttttgtttgcaacagcggattactttttgacggcgtgtatataatgaatggtctcaaatgcggttaaatggtcagtgcgtccgctgaaaaaacggtcattgacgtccgccggagatacatgttcataaataagcagacctgatgattctaatattttttcgatttctttataactgaaacacgataacatcggttctccgcctgctgcagccattttcaccatgttttccactctgtttgacagtcctctttcttcaaagagcgactcatctgcataatcaaacacgatagagcttcccggcgggacttcggcaaataattgtgtgagcaggcgggcgagatgctctttcgtaaggtagtatgacacaccgagcaggctgaaaaaggttttttggcgtgaaaaaccttcctgatacagacggctgaaagaaagcgaagcggcgaagtccatcggtacaaaatgaagatgatgggaaatgtcgagattcagatgtttcaatctgtttattttgtcttcctgtgaagcgggatgatcaatttcaaatatgtctaagacgtttgtcatctcaggatgcctgaaacagaaagtatcgagccccgcgccaaggataacatactgtttggccccgagcttcacttcattcaaaagcacttcttcacaatatgcggcacgggctaacggtgtaggagacagctgtacttgagtcacccattttaagatgtcatccggttggccttgaagcctctgtgccatgtctttactgaaaaatgatataccttgaatcagatgatcgcggatgtccgaatgctctttttcggaaatcagatcttgtgccataaaatcatcaaatatcaccggggtgtcgtatttactgtggtacgcccttccgaaagcggacagcagggaagtcatactcgccttgttttctttcatataaagatcctccgttatttacatcaatctccggccgggagaatcttattatacatgttaatccaaaaatgtaaattataacataaataaatttttttgtcaagttttaagcgtaataaaaagccgctgtgacagcggcttcggggttacttcgttaagctttttgtgatgtagtcgagctggccttcaagtgagatcgggtctgagaaatagaagccgatcggatcaatgcggtagacatggttttgtttgacggcatcgaggttcttccagattgagctgtcaagcacgcctttgtcgtcaccgccggcctgccatggccccataaagatgtagtctcccgcgaagtcaggcagtttctcgagtgaaatgctggcgtagcccggcccttgattaatggctttttcctgcgtcagttttgtggccttcagcccgagtttgtcataaatgatgcttccgccgcggccgaagtctttaccgaatacatagatgtcttttccgtttgtctgcatgatggagatggtttttgagccgaccgctttttgaacctttgttttagcggcagcggttttcttatcccattcagccagccatttgtctgctttatcttcagtgcctgtcattttcgcaaactctttgaattgatcaatgttgctgagcttgtcatatttaatggcgatggtcggcgcgattttttccagtttttcaatatcggcgccttgtgtcgtccagacaacgattaaatccggctttaagtcaatgattttttcaacggacgtgccgtcgccgatgtttgtgacaccttttgttttccctttgtaataagggtttttaaatacgttttgcggcgcgccgacaacattgatgccgagctgtttaaagtcgccgtagtagccgtcagccatgacgacgacccgtttcgggtgcttcggaattttaatattgccgttttcggctttatacgtgatggtttcttctttttcagaagaaccttttgtgtctgaagaattgccgcatgcggccaaagcggcgaagagcagcacggcaatcagcgctgcgccgattttcttgtatgtatggaacatctgacattccttctttcataaaaattagtgataaagagaatcattatcagtgtgattatatcactgctttcatagagaagcacgctctttttaaagaaaaactttctttttttatatgaaattaggtctattaaaagagaagataaaagtgctatactgaaacaagtcattgataatcattatcattaccattcttgttttgagaaaggaagaacgagtgttgggtctattgaaaaagaaacagacaatgacggctcaaggggcatcagggagtgaaatccagtggacggcgcgttcattccgggctgctgtgctgctgtgtgccggtattgcggttttattgatcggcgccgctctgtctgtttccatcggagctgccgatattcatctgcggacggtgtgggatgctctctttcactttcagccgcaaaatacatctcatcaaatcatacgcgatctgaggctgccgagaaccgccgccgccgcgctcgtcggggcttttttagctgtgtccggagcgattatgcaggggctgacgcggaacccgcttgctgagccttccattatgggcgtgacgtcggggtcaggatttgcgatcgcattggcatttgctttttttccgggtctgtctgcggcgggacttgttttgtggtcctttacgggagcgggaatcggagcgcttattgtgtttggcatcggcctgtcttcaaaaggcggtctgacaccggtgaagctcgcgctggccggtacggcagtcggctatttcttaacggggctttcaagcgcgattgcgatccgttttgatgtcgcccaggatgtgaagttctggtatgccggaggagtcgcttccgtcaaatgggaaggcatgcagctgcttttggcggtcggggttatcggactattgctggcatttctgattgcgcgctcagtgacggtgctgagcttgggtgaggaactggccaaagggctcgggcagtacacatcgcttgtgaaagtaatcggaatgtttgtcgttgtcctcttgacgggggcttcagtctcagtcgccggagccatttcttttatcggcttggtgattccgcatatcacccgatttttagtcggggtagattacaggtggatcattccctgttcggcggtattcggcgccgttctgttagtcttcagtgatattgccgcaagactcgtcaatgcgccgtttgaaacaccggtcggcgctttaaccgcccttatcggcgttccctttttcttttatttggcgcgcagggaaaggagagggctgtaatgaatgtaaaatcgaaaaaaccgctggcggtcatggccgttacgtttgtgctcatatgcatcgtcttttttatcagcttaaacatgggtgtgatccggattgcgccacttgatacgatgcgtgtctttttcggacagggggatgcccgggatcagctcgttttatttgaattcagactgccgcgcatggtgctgtcattgcttgtcggcgcaggaatcgcggtttcaggcgcgatttttcaaagcgtgtctcaaaatgacttggcggagccgggcattctcggtattaacgccggggcgtctttggcggtcgttctgtttatcttctttttccaagggtcagctgttgatctaagcatggccagtacatggctgcttccggtgagcgctttggcgggggcttttctggctgcgctgctcatctatgtgctggcttggaaaaaaggcgtttcacctgtccggctcgttttggtcgggatcggtgtcaatgcggggtttaatgcgcttctcttgatttttcagctgaaaatggacccgcgggatttcatgcaggcgcttgtatggatttccggttcgatttggaacgccaattggaaaatggtgctgtccattttgccgtggctgctggttcttttaccgttcagcctctataaagccaggtatttaaatgtgctccagctcggtgatcagctggcggcggggcttggcaccaaggttgaaaaggagcggcgcgttctgctgatgtccgccgttgccctgaccgcgtcatgtgttgcggcagccggcggaatcgcttttctcggactcattgcgccgcatttggccagaaggcttaccgggccgcgccaccagacgcttatcccggtttcagctttgatcggagcatttttatttctgcttgccgatacgctggcgagaaatgtgcttgcaccgtccgaagttcccgtcggcctggtgatttccgtgctcggagcgccgtattttgtatatttgctgatgaaaacgaaatagaggaaggagactgccgcgatgaactcattatcggcggaacagcttactgtcggttatggcgaccgtttgatagcgaaagaattggatatcgccatcccgaaaggaaaaattacaacgctgatcggtccgaacggctgcggaaaatcgacggttctcaaaacgatgtcaagaatcatgaaaccgaaatccggcgccgtctatttaaacggacaggcgatcatgcaaaaatccacgaaggacatcgccaaggaaatggcaattcttccgcagacgcctgaagcgccgagcgggctgacggtgtacgaacttgtttcttacggcaggtttccgcatcagtccggaatgggccgcttgagtgataaagaccgtgacatgatcaaatgggcgcttgaagagacggggatggccgaattttacgaccggccgatcgaagcgctttccggggggcagcggcagcgtgtgtggatcgccatggcgctcgctcaagaaacggagctgctgcttcttgatgaaccgaccacttatttagatctcgcccatcagcttgaaattttgcagctgctggacaaattaaacaaggagcagggccgcaccattttaatggtcattcatgatctgaaccatgccgcccgtttttcccattacatgatcgcgctgaaaaaagggcgcgtcatcaaggaaggaacggcggaggaagtcatgactcccggtatattggaagacgtgtttcaaattgacgcacagattgtaaaagatccgcgcacgaacaaaccggtctgcttaacctacgatttaatccggcatgaaaacgcaactgtaagatgaaaaaaaacgcagagccattccggcctgcgtttttttagtgcgcccggggctgcttttgtccggagacgcatttatccaaaacgaaaaaaacccccgccacaatcagctcctccgtcgttgacagccaaatcttttcaatcagtttatccgtcgtatacgcagtcatccagaggaacagcagctgaacggtgccggctaaaaggagaaaaggcagcctgcccgtcccaaaaaaggtaaagctatgtatcatcagccgttcaagcggttcaaaacataaaccgagaagaataaaaagcacggaaaaaagcaggacgtacgccatcgatccgtagctcgtcccggctaatgaaaatacggccatcatcacgatgaaatacccgaataatacggcagcggctgccagggcataccggagcacctgaagaaaaaacattttcgtcccgttttgattgatcatctgttcagctccttttcacacagaggagacttgcagagacggaactctgcaagtcgggtgtgtatcttcagcatttctttttgacgacagggtgtttctctttcgaaagaatatccgtaaagtctttgcccagatccagatgctgctggacgaatttctcaggaagcatggcaagccattggttcagggacacatcggcatagtggtcatccttgaagatttccaggaagacgagcggctcatcccccaaattctccacatagtggcccattgcgaacgggacgtaaccgacatccccggcctgatagttaaatgttcttgcatggccgtccgatgcaaaaaccgtcatccgtcctttaccggaaatataatactgccattcatgcgtattcggatgccagtgcagctctctcattgcgcccggttcgaccacgacaagcgctgaagcgatcgttttggacactttgaagtttgtggaatccgcgatatatactttgccgccttccgtctcagcagtcggaccttcatcgagcaggcggtaagtgaacggataaggcacttcgccgttcgggccttccacaatgtcgtctttcagcttcccgggaaccggctcttcaaagatgtatttttctttccgaggcaggccggcgaggtctttttctgaaaccccgaaattgttggcgatgacatcaagcggcgtgtgggcaagccagtcagtcacttggaatgtgctgttttctgagaaggaaccgtcatcaaaaaccaagaggaattcacagccttctttcagcgcctgaatggagtgcggcaggcctgacgggaagtaccacagatctccttccttcacgtcatcgataaaactgcgtccctgttcatcaacgatcgtgacccgcgctttgcccgtcagcatatatgcccattcggcttctttatgccagtgcagttcacggatggcgcccggttttaaacgcatgttgacagatgccagattttcagaaatcggcagctcgcgaacggtcacctcacgcgcgtacccgcccttttccagccggttatgcacatctgagaaagagaatttcatattatccactgtgccgtgatccgtttccggcggcgtcagcatatccggattttggcggtctctttcaagattgcgcggaatcgtgacggtcgctcctttgtctcctctgatcggctgcgggatattgcagttgttttcttttgacatgtaaatcgtctcctctcaagctttgttttttcagaaagagaatgtgaaaggcctttcgttttcccttctgctttgttaagtgatgcgttccgatgaaaagtcaacttcgtgtgaaaattaatttttcattttctgatctttcagttccgtcatcagttcgatcagggcgtcaaacttcttctcaaaccgtgtgagaagatacatagcaatcagagccggaaagccgagattgccgatctgtctgaccgcttcttctataaaaacctgatccattgtcagccacctcctgacttgacctgcagtcatgtatataagtgaaagaaagagcggctcctgtaaacctgatatcccggttgagggtctttttttttgttccggcaaatccgggacataaggaatgcggaatcttagtcggaaaggagtagtttacttttttttgctttctttcatttaatttaaatagggggcggttttatggactatcaagttcttttacggtcaaaatgcaaggaaattatgaaacatccgatcgttaaacattttttaagtgacccaaagcattacgagaaatttaaaaatgtgctggaacattcagacgagaaggatgcaaaatcattggacgaccattttaaacagttttataaggaaatccggatcatcaaatatatgaactctatgatccggattttctccatcgattttgacaagcgcatccgtaaaaatcagaatcgctatccgctgacggtggatcagccggagggaggtgaagcgcttccctatgaaatgggaaaagacgcgtatgaagagtttctgcggaagcagggagatttgagccagcatgtccaaaaccgtgatttatacgaagcgcttcagacgttaaccgataaacaaaaaagcgtgctgacgaatatttatcttcacggagcgacgatgaaagagattgccgagtcgctgggtgaatcacggcagaacatttccaatattcataaaaaagggctcgacaatctcagaaagcagctggacaagcaaaaaaagggggaaaataagcagtgaacgggccatttgacttcaacaaagagaacacagataccgacgaaatggaacttttgatttcacgtttttcgccaatgataaaaaaaaaactgagcaatacatcataccaggaaagagaagaccttgaacaagaattgaagattaaaatagttgaaaaagcggacatgctgttatgccaggaagtgccgggtttttgggaatttattcttcatcttataaatgaaagctcctgacaaaagcggcggaatgatggatattccgctctgacaacgtgagaaaaacgagaagagatgtccgtctcgtttttcttttctgtttccccgcaagacctccgcactaaaaaggtaccaaatcttatccatataatgatatgatgaaaaaaacaaagagaaaggaacgtccaaggtggaaaatgcgtcaattttaattgtagacgatgagaaggcgatcgttgatatggtcaaacgcgttctcgtcaaagaaggctatcacaacattaagacagccggaagcgctgaggaagcgattgagtttgttaaacatgaaaccgcggatctgctcgtgctggatgtgatgatggaaggcatgtccggttttgaagcatgcaccgaaatccggaattataccgacgctccgatcttttttctgactgcccgttcttctgatgcggataagctgtcaggatttgcattgggagctgacgattatataacaaagccgtttaatccgctcgaattggcggcgcggatcagagcgacgttaaaaagaacctataagcgcgaagagaaaacggcggtaaaaacgtattcatacagccatttttcctattcgccgcaaaacgccgagctgatcgtcgggggcgagcccgtcagctgctccgcacagcttctgcaattgcttcaatatttctgtgaacaccctgatgtggtgctctcaaaagatcagatctatgaaaaagtgtggggatatccgtcttacggcgataacaacaccgtcatggtgcatatccgcaagctcagagaaaagattgaaaaagaccccagcaatccgtcttatattgtaacggtgcgcggcctcggctatcggtttattcccgatcaaggagaaaaaggaatccgctcatgagaatgcgcggaaaatttctgctccactttttcggacagcttctgcttgtcatcctgctgatgtccgttttggccgtcgcttctttcttctatttggattggcgtttcagcgaagcggaagccaatgcgggactgaccaaagcgacggcagactcgtttgaagcgtggcttgataaaaacgaagacggcacatgggatgtcgatgaatttttaaagatgtcggtcagaaagcagaagggctggctgcagatcattaatgacaaagaaaaaacggactacgcatacagagtgccgaaagacgtcccgagccattacagcagaaaagacctcttatccatttaccagtaccggaattttgacaactacaagctgaattactggacggtcacgataaatgatgagacctatttgattctgttcggctggaaatccgccagtgagcagcttctcacttacatcgaatcacaggagccatccctcgcttccctttctcaatataaaaaaagcacggttgattatattaaacgggaaaaaggggcggtctaccttctcgaaaacagcggcagactgctcggggatatcaacagcacgaaaaaagaacggaacaccgtcaatgagcttgaattgctgaaatacagttccaagccgtggaattacaaacgggaaatttcttttaaaagactcgataaaacgaaatggatggtcgcgtcggtgccgaaccccgtgtacatccccgatcacgagtttaacaaatcatttttgagaaatgtgatgaaaaccctcttcctcttgatcggaatcttagtatttatgatctgcatcctgaccatctggtactctttccgtttcggctggccgctgtttcataccatcaaatggcttgtcaatttatcaaagggccggcttgaagagccgaagaaccgcaaaggacagccggtcagcaaaaacaaaaaaggcaaaacaaaacagccgttccgctttttcgccgagattttcgaatcgatggatcagctgaccgacacgctgaagcgggataagaaaaacagagaaaaaatccaggcgacaagggaagaatggatcgccgggctgagccatgacttaaaaaccccgctgagcacgatttacggctacagcatgatgcttgaatcgaagcaatacgactggacaccggaagaagtcaaagaaatggggcagatcgtccgggaaaaatcagaatatatgtctaagctgattgaggacttaaacttaacataccgcctcaaaaacgcggccctcccgatcgaacggcggctgatcaacgtcgtgccgtttatcagaaacgtcacgaacgattttacgaaaaacacgttctcggaaggctatgacatcgcctttgaaaccaaaaaggaagacattcttttcgccattgatgaagcgtggttccgccgtattctggagaatctgctggcaaacgcggttaagcataataagaaggggaccgccattcgggtggtgcttgaggaatcagccgaacagctcattctgaaggtgaaagataacggaagaggaatggacgatgaaacgattcaccagctgtttaaccgttattaccggggaacgaatacgaaggggccgtcagaaggaacgggactcgggctcgccattgccaaagagctggttcaccttcataacggaaccatccatgtcaacagcagaatcagcgccggaacggtgattacgattctttttaaaaaagattgagtttggacgccgctttgtcgggaataacaatagaagactgacaagcaaaagaggtgttcacacatggaagcagcattacgagcagatacgagagcagttatcggagaaggccctttatgggacaaggataaggaatgcctgtactgggtggatatactgggcagccagctccatatcttcactccggctgacggaatcaaccgttccgttaaattcaactcatttgtcacggctctggccttgtattcaaaggaagagctggtgatgacgatgaaagacgggttttacctgtacaatctgcgggaagacacattgacgaagatgaagcagccgaaagacatgcgggaagatatccgtttcaatgacgcaaaatgcgacccgtccggcagattatgggcgggaacgacgagcatggaaggcaaagaagaggaggcttcgctgtaccgtctgaatacggacggcagccttgccaaaataaaagaccaggtctccacctcgaacggtttggattgggatcgggaccgaaacctgatgtactatattgatactccgacgcaggaaatcgtctgttatgcatatgatcctgaaaccggagccgtatcagatccgaaaacggtctaccgctttccggagtcgcaaggatctcccgacggaatgaccattgaccgtgacggaatgctgtgggtggctctgttcggaggcggccgcgccgtccggattgacccgtttttgcataaggaaattgcatctatcgaagttccggcgaaatacgtcacctgctgcgcgttcggaggcagcaatttgaacacgttatacattacgaccgcgacggaaaaattgacggaagccgaaagacttgagcagccgcatgcgggcggcctgttttcagcagagcttgagacgggcggctgggagccggttccgtttgcaggcatgatgtaaaaaaaagccctggcatatggggaagttccccttgtgccgggcttttttgtgttaaatggagcggatgatgccgccttcaacccgctgtgcggtgccgttaatggcagaagcagctgatgaagcgagaaatacaatcgtattggcgacttcttccggggttgcatagcgctgaatcaaagatgtcggttcattcactttaaaataatcccggacgaagctgtccgtgtcttctccggcagcctttgcggctccttccatgtaagaagcgacgccttcggtccatgtcggtcccggcagcacggagttgaccgtgacattcgtgcctttcgtcatttccgccattccccgggacaagctgattaacgccgttttcgtcattgaatacggaatcatttgcgcaagcggtttgactccggcttcactggagatgttcaaaatccgtccgctgtttctttcaagcatttgcggcagaaaacgccggcacaggcgcacggcgctcataacattcacttcaaaataccgagtccattcgtcatcagacacctcagcgaagtcctttacttcaaaaaaaccgagattattgacgagaatatcgacttccccgattccgccggcgcgcttgatcaggtcatccgcctcatcctgacgcgataaatccgcagcgatgccgtgaaccgttccgtaagcggaaagctcctcaaccgtccgttccacggtttctttttttcttccgtttacaatcacctcggcgccttcggctaaaaagctttttgccgcggcttttccgatccctgaagttgatcctgtaatcaatacgagctttcgttcaagctgtaattccatgataatcctccttattacaccattgtgtaacagtatacatgatgaattttagtgtgtacgaacaatttgctttcatgcaaaaaggccggatatacaagccttaaagacttatagtataattactgcgaaaaaaggatacgaatgtcaaagagacaatcgtttaccataatcagggggagttaaaagaatgaagaagatcactgccgtctgggcggcgctcttggtcaccgcctttgtgatcgccggctgttccggcgcacaggaagaaggaagcgcggccaaacaaaaagccgtctcaaccgaagcattcccggtaaccattaaggatgccgcgaacgaaaaagtaaccataaagcaggcaccggaaaaaatcgtttccctcatgccgagcaatacggaaattacatacgcgctcggactgggagataaggtcgcaggcgtcacgacaaatgatacatatccgaaagaagccgtaaaaaaaccgaaagtcggagatatgaatgtgaacgctgaaaaagtcatcgcgctgaagccggatctcgtgcttgcccacgcgtcctctatgtccgcttccgccgatgcgatgaagcagctgaaagatgcgggcatcaccgtcttaacggtcaatgatgcgcaatcgttccaagatgtgtacaaatcaatcagcatgatcggaaaagcggccggcaaagaaaagcaggcggatcagctgatccaatcgatgaaatccgacctttccggcatagaaaagaaagcggcggccatttctgaaaaagacgaaaagaaagtattcgtcgaagtgtctcctgacggctacacgacggggaaagacacgtttatgaacgaaatgcttgaagatatacatgcgaaaaacgccgccggcagccagaccggctgggtgcagctgacggatgaagcgattgtcaaaatgaatccggacgttatcatcacgacagacggcgtaaaggccgctgaagtggaaaaacgcgccggctggggtgccgtcaatgcggtcaaacaccacaatgtctattctgttgatcctgaccttgtcacacgctcaggcccgcgccttgtcaaaggggtcgagaagcttgcagaaagcgtttatcctgaaacgtttaaaaagtaaccgcccgctggcctacacggtcagcctgctgtttttagccgtttgtacggcactcggcatttcaatcggcagtctgcatattcctttatccgacgttttttggatcgggatcggccggacatcctctgttgatcccatgaatgtaaatattatgatcaatatccgcctgccgagagtcgttctggccgctcttgtcggagccgcgctatccattgcgggggcggcgtttcagggacttctgaaaaatccgctcgccgacccttatacactcggggtatcttcgggagcctcggcgggagccgttatcaccttgtttttcggcattcagattcccgtcatcggccggttcacacttccggttgtcagcatcgccgctgccattgcggttatggcggcggttctgtttttcagccgcctcgttcatgcgtcgatgtcggtttcgacgctcattttgacaggcatcattatgaattcttttctcggggctctcatttcgcttgtgattgctttaacgggaaatgatctgctcccgattgtccgctggctgttgggaagcgtgtcaatgaggggctggggctatgtcgcgctgtttctgcctttttttctggccgggacggcgcttctgcttatcaatggcagagaattaaacattatgacttatggagaagaaaaggcaaagctgttaggcgtcagtacgggaaaaagaaaactgctgatgatcgccgccggatctctgttgacgggaggagcggttgccgtctcggggacgatcgggtttgtcggccttgtcattccccacgtgacacggcttttgtggggacggatcatcgccatttactgccgctgtcagcattgacgggcgccgggtttctcattttggcggatttgttttcccgcaccgttattgagcctgtcgaattgccgatcggcattatgacggctttggcgggagcgcctgtgtttgccttgattctgcttcgccagcatcatggagggaaacgcttatgatcagggtgagcagcctgtccggcgggtacggaggccggatgattgtagaagatgtcagttttaccgccggaaaaggtgaatttgtcggcatactcggtccgaacggctcgggaaaaacaacgctgatgaaattgctgacgggaatgctctctccgtcaaagggcgaggtgctcgtcgcaggcaggcccgcgggcagatacaagccgcgggagcttgcgaaaattatggccgttttgccgcagcatacggagcaagcttttacatttaccgttaaggaaacggtgtccttcggcagatacccgtatcaaaaaggactcttcagacagatggatcaacatgacgaagacattgtccgggaagcaatggaaatgacgggcatcgaccgatatgcacagcaatccgtccgcaatctgagcggaggggagcggcagcgcgtctatctggcgcaggcgctggctcagcagcctgaggtgctgtgtctggatgagccgacgacctttcttgatctcaaatatcaaaaagacctgcttgatacggtgaagcggctgacgagagaaagaggcctgacggtcatcagtatttttcacgacctcaacgtcgcaagccaatattgtgatcagctcctgatgatgaaagacggacgcgcttttccgaagcagccaccggatcaggctttgaaaaaagagacgattgaagacatttacggcattaccgtcagcgctgttgcccggcaatcgtcgccgaaaccgctgatcgctttcatgccggaagcgcgggaggaaagagagcccgccggcgttccgttcgcctctctgataaacaaaagcggaaataccgtaacgcttcatacagaacggccgtttagaatgctgtcaaccgcatctgacggcccgggcttttcgtggagccgccggctttccggctcggcggcagctggtttgatctgccgtacgtttgattcggttacgatagccgtgactgcgcagtataccgtttgggtgctgatcagcggacgtttatcggaacagggatttgttcggctgttaacggcagcggctgaagcgagaatgcaggctctttccggcagactggcaaaaggcgacattgccatttgtgccttgcagacaggagaggcaatggacgtccctcacgcggaaagagccgtcagaagaggaaccgcggtatgtgtaaaagcggcggaagaaggaggaatacaacaatgaagctttatacgaaaaccggcgataaaggacagacaagcctgatcggcggcagaacggataaagacagtctgcgggttgaaagctacgggacgatcgatgagctgaacagctttatcgggcttgcgcttgcggagctagataattgtgagaattgcggtgatgtgaaagccgaactccgaaacattcagcatgagctgtttgactgcggcggcgacttggcgacggtcactgaacatagaagctatacattaagagagacatctatttccgcattggaagactgcatagaccgttacacggctgaagcgcccccgcttgagaaatttattcttccgggcgggcataaggcggctgctcagcttcatatcgcgcggaccgtcacaagacgggctgagcgtctcgtcgtgaaactgggcaaaacagaagagataaacgatacggtgatgcgttacttgaaccgcctgtctgattattttttcgcggcggcaagagcagttaacgcaagacagggcgttcaggatatagagtatgaaagaagcgccgcggtattccgtgatgatgaataacgttttgttcagccggcagcagcaagccggctgtttttttatagagatatccatcaattgaacctttattgacagaaggaaaatgtatcttatgcattattgactgaaaaattaaaaaatgagatattataagaaacattgtaaaataatgggggatttgatagatggatacatataataagagcgagagcatctggaataaaaatttcacccttctgtttatctcgaggcttgttaaattgtcaggcgacggttttgcctttaattccattctgtggtttttgatttttgacggggaaggcgcgatcggcacgtccctgctcattgcggtcacgttccttccggaggcgatgctggcgccgattaccgggccttttatgaagcagcatacgctgaaattctggatgtatttctccgatctcacgcgcgcggcggtcgtgttgatcattccggtctgttactttaacggtttttctcctttatggtttgtcatgcttctcatgattttgcattcagccacgggagccgcttataatcctgcatctatctcattaatccccaatattgtcggagaaaacagcctgcagaaagcgaatgcggtcatccagtcatcaggccagatcgtcagacttgccgccattacgctgagcggggtgttcttaacatttatcagtcccgcttattctttgtttatcgctcttatattctatcttctatcaggttttctcgtactctttatgtcataccaagtccagcatgccaaagaggataccgtcgccgtcagacagcgcgggacgtatgtcggaaggctcaaacggggtttcgttcttgtcaggaaacaccagattttatacccgctcgccatctattgtatcttcatgaattttgcggccgctccgtgggaggcgctctctgccgtttatgtcgccgaagatttaaacatgccgccgatcatctactcgcttttgaaagcgacaggcacgggcggagcctttttaatgggttttattttggctaaggtgaaggtgaacaaatacggtctcctgtttgtgtcagcgggaatcatagaaggggcggcatttttcatcaccggcctcaacacttttctgccgctcgtcttcctcgccgcgtttgcgttcggatctgccgtcagcgcgattaatgtgccggaatatacgattattcagacgtctgtggaccatgatgatcagccgcaagtctatgccgtcatccatatgatctcaaacatatccattccgctcggcgcggttctttgcggatacgcggctaacgccttcggtcccggaaaagtcattgccgccggcggtctcgttgaagtcctgtccggtctcggaatattgctctttacgaagctggccaaagctgaacgctcagatctcatcagggaaaaagaagcgagcatcagaatatagatttttcgtgaaacgccctgcgccgtccggtgcagcggcgtttttttatgcgaaggtccgggggttatacgactccggtctgatatgaaaatcaatctctgactcgttttgccggccgcgggatttgtttatagtaaagacaaggaaaacgaaaggaggatctgcatgaatataaatgtaaaaacggcaggcggctttctgctgattgtgttcggactttctgtctttttcggaggaggccatttcgcatttatcatcccgctggcgatcggaggcctgatgctttactggggaatcaaacgtttttcaaaaggccgggcggtatcgggtatcatcgcgggcttcatcggagctatgattctcgtcggttctcttccatttatcgttgccatcggactggctggcgccatggtgtatttcgggtggaagatgatgaagcagggcggctcagacaccgcttcccgccagtatgaaccggaagcggcatcaccgggctatcaatccggatttgactctgaatgggaagaatttctgaagaaaaaataaggaggaagacaaaatggtcttaaaaagaataagaaatatgttcgtcgcatctgttaacgaagggcttgataaattagaaaatccgaaagtcatgctgaatcaatatgtgcgtgatatggaaagtgacattgctaaggcgaaacaaacgattgtcaaacagcacacgatcgtccatcagtttaagaaaaaacaggaagacgcttccgaaacggcggcaaaacggaaaaaccaggctcagcttgcttttgacgccggggaagaggagcttgcgaaaaaggcgctgactgaaatgaaataccttgagggaaaagcggccgaacatgaaaaagcgtatgagcaggcgaaaacacagctggcagagctgaaagagcagctggaaactttagaaacgcgcctccgcgacgtaaaggataaaaaacaggcgctcatcgcccgcgccaacgcggcaaaagcgaaggaacatatgaacgcttctttcgacaaaattgacagtgaaagcgcctacagagagtttcttcgaatggaaagccgcattgaagaaatggaagtccgcgtcaaatacggcacttcagctgaggcgaacacagaatacagccgctcccaatattcagacgaggtggaagctgagattgaaaaaatgcgctcgctttctctggagaaaacagagcatcaaaaagcggctcatgaataatgtgcacaagggaagatcggcgcttttacgcctcttccctatacgcacgtatcaattctccggcttttcctttataataaaatgaatgaaaaaggatggaacgtaatgaagcgtaagatggccaaaggactgatggcggcgtccgttctgatctgctgtctgtttttggtgaaagaagtgtttgccgggcgtttttttccgctgtacgaaacagaagcggaatcggcaagcataccgccgcgtgccgtcaacagcctgtcggtttcatcggaacagacggatgtaaaaatcatcgcggaagcgcggaatgatatcgcggcaaacatggcgggaccggcggggaaaatgtttgtccaaagcaggggaaaaaccctcaatctcaaagcgaaggagaaagggttccaatttctgaatctctttcagcgtcctctgctgattgtccgcattccgtatgattatcatcgggacattaccgtccatacgtcaagcggcaccattgccgttgacggaaacaaggggctgtctcttgcgcacctcggcgtccgttctgtaagcgggaatatgtcgctgaagcacgtgaagacggatgtgtttgaagcgaaagggctgtcgggcaacctcacagcatcaggccttgcggcgaaaacgggggatatccgcttatcctccggacatgtcgggcttcaacatgcggcgggcgcccttgacgtgcgggtcgcttccggcagtgtcgacgcctcgcttgagatggcggatgctcccgtatccgtcaggcttgcgagcggcagcgcagcgatcagcctgccgaaagacggaagttttacggtgaacgccgagacggcaagcggaaggattcagccgtcttattcctttgagaaaacgagtaaggacggcggggcattcaccggtatgaagggcagcggcgccaggccgattgatataaaagtgacgagcggcaatattgcactgcaatagtcaaggaaaggaggggcaggcagctgatggcaaaaaaacagattctcggacttatcatcgccttattaggcgtcagcatgtttttgcgtattatcggcatcggcgacttcttgttttggccgctcttttttctgatcacaggctatatttttaataaatattcccgcggctggctcggctccgtcctgtatatcttcgccgcttttttatttttgaggaacctgttcagcgccacctttaacctgttcggctatgccttcgccgcctttctcatatacgcgggctacaggctcctgaaaggaaagcgcgtgtatgaacataaagagaagaaaatcaatcttgaaaaagaagagcagccaaagccttccgcccagacggaaagcagacagccggacctccgcagcttttttatcggcgagctccggatgatgaaggacccgtttgagctgaatgatttaaatgtttccggattcatcggcgatgtgaaaattgatttgtcaaaagcgatgattcccgaaggagaaagcacgatgaccatcagcggtgtcatcggcaatgtcgatgtgtacgtcccgccggatatcgaagtgtccgtcagttcatcggcttttatcggcgatatgaacctgctcggctctaagaaaagcggcatgagcccgaatctttataaagtatcgtctgagtacggcgactcgccgcggcggattaaaatttcaatttctttattcatcggcgatgtggatgtgaagtatttatgaggaaaaaattactcgccaatattcagtggcgcgccatgcggatgactgcggggctcagtctgctcctttgtgcggtgtttattacgctgatgctgctgtattacgggcttgacccgatgctgctgttttcttccggctggttcggtattccgtttgtggtcatcctgcttctggcgtctctttcggccggattgatttccggttatgtatacggcggccgcctgaaaacaagaatggatacactgattgaagcggttttgaaatttgaaaacggcaatttcgcttatcgggtgccgccgctcggcgatgatgaaatcggcctggcggcagatcagcttaacgaaatggccaagcgggtcgagctccaggtcacatcgctgcaaaaactctccaacgagcgggcggaatggcaggatcaaatgaaaaaatcggtcatcactgaagaacgccagcggctggcgcgcgatctgcacgatgccgtcagccagcagctctttgccatttctatgatgacatccgccgtcttagagcaggtgaaagatgcggatgacaaaatcgtcaaacggattcgcatggttgaacatatggcgggggaagcgcaaaacgagatgagagcgctgctattgcatctgcggcccgtcactttagaaggaaaaggcttaaaagaagggctgattgagctgttaaaagagttcaaagcgaagcagccgctggatattgagtgggacatcagcgatacgggtgtgtcaaaaggtgttgaagaccatctgttccgcatcgtgcaggaggcgctttccaacgttttcagacattcaaaggcgaccaaggtcaccgtcaggctcggcgcgaaacatcaaaagctgcagcttaaagtcattgataacggggagggttttacgatggatcaagtgaaagcatcctcatacggcctgcattccatcaaggaaagagcgagtgaaatcggcggcatagcggaaattatctccgtgaagggaaaaggcacgcagatcgacgtgaaagtcccgatttatcagaaaacaaaaggagagaacgacagtgattcgagtgttactgattgatgatcatgagatggtcaggatgggtctggccgcatttttagaagcacagccggacattgaagtcgccggtgaagcatcagacgggcagcagggcgtcgatctggccgcagagcttttgccggatgtgattttaatggaccttgtcatggacggcatggacggcatcgaagcgacaaaacagatctgcgcgaaactcaatgacccgaaaatcatcgtgctgacgagctttattgatgacgacaaagtgtatccggtgatcgaagcgggagcgctcagctatttgctgaaaacgtccaaggcggcagaaatagcagaagccatcagagcggctgccaagggtgaaccgaagcttgagtcgaaagtggcgggaaaagtgctgtcaaggctgcgccattcagagaatcagcttccgcatgaaacgctgacgaaaagagaactggaaatcctctgtctcgtcgcggaaggcaagacgaataaagagattggtgaagagttgttcattacgattaaaacggtgaaaacccacattacgaatatattgtcaaagcttgatgtcagtgaccgcacgcaggcagccgtatatgcccaccgcaatcatctcgtgacataaaaaaaggagagcggcgccggcacactctcccgagggacggggtcattgggacattccctttgttccgaaatccctgatggcgactttgactttgtattcaatatccgattcactgaagtgatgatcccagtcagaggatatctttttccatttatcaggataatgaatccggacttgatcgcctaacccggtaatatccactttcaactcatgctgcatgtaatcaatgaatgccataacatctgaatgaatgctgcgttttaccgcgtttttgatttcatttatataggactccttgaaagaatcttctttcggattccaatcctcagacagacggccttcaacaaaccgggtgacgataaacttgaattttccgtttttatattgtgtttttacattatatttgctggaaaatacctcgaaagataaataataattgtcatgctttgcaaacgtgacgcctccctttaccgtgcctgtgaacaggttcatattctggacttgtaaaggcgttaaatttgcataccagaatttatttttaataatggtagcgccccagatttccagtctgctgcccactttgcgcacttgaggaagggcaaaggtttcgcccttggcgattttctctgatatttcccccaatgtcacgggctccatcatccggatggtgaccgaattattctccgttaagtcatagatcgtatttgacgcaggttctccctggtcactgatattgaaaatatctttcgttttatccggcaccgtcatcacattgcagcttcttctcgtaccgttgtctctgataaattggttcatcaatgcgtcaagcggaatgtcatcctttaacagcgcttcggaaaacagcatgatacgcaagtgctgggagaaggcggggtgattttttaacgatgccgttcttaatgcttgatggacggtttcccctggagtggaagtcacctttgtcgtgtcacctgacgacgactgctgggcacttgctttttgcggaaccagaatctgctgtgtcacttccacattttcttccgcgggtttatctagcccgactccgataacgaggctcaagtcttctaaattgcggctgtcccagcacccggccaaaagcaatgtgcaaaatatgattacgatgtatttcttcattgtgcttttttcaccttccttttcacagcgacgactgcaaacatcagtaaaggcagcaaaaagaaaaccaagaagatatagccgagaatatcactgaacagcatcagcttgtttccgtcttttggcaacaatgatccgaagaatgtcgcgatgcctacgaagatgatgccttttttctgtttcagcccgaaaattttatgaagagctgatgtcgcgaaatatccgtatgatacataggtggcgaaaaactggatgatccagacaacaagcaaaaaggactcgaacctttcaataaaaagccctttgatttcaaatgattgaaagagcgcgatcgttggccagatcattgttttgacatcctgggtggttaaggcgccgacgacgagaacgtaggtaatgatgtataaaataatcgggatgccaaagcctatggccgacatgcggaatgtgtgctttttatttttgaggtactcggggagaaacagcataatctcaattcccaagaaggaaacagaaacgacggtcaaggaagccataacgggagaaaatccctgcccgagcaccggccgcaggttgtccagatcaaatattttaaagctgaaagaaaacaccaccagcaaaataatgatcgtaatcgttaaatagaaaggaaagagcctgccgatatcgctcatgccgccgataattaaataaacggaacaggcgataaagataaacagtgtgaccggcacgggcgttctttccaataaaaagaacttgaccatttccgccatcgcccgggcttcgaagctggcgactcctataaaatagagacagatcatcagattgacgatatttcccgcccatttgccgagtccttcattcatataatcaaataatgatccgtactgatgctttttcataatgagcgtattgagataaatcaaaaagataaagatgacgccttccagacataacgcgatccagccgtccggcgaatttgccctggatgacagcgcccgcggcatggtgaggagccccgcgccgagcatcgtgtttgcaatcaatgctgtcccttgatagcttgtaagcttattgtgagttgttttctggctcatttacgtttttcgcctcttttggttgatttttaatagggagacggagaatagagtcgtttgcgttttttaagctgaaaaatccattcggcgagaaatacggagaaccgaagcttcgctgtctcgataaatgagtgtagatcgccagcataaataaaatcatgccgtacagcccgaaagctgccgcggtaaacatcgaaataaaacggagcacacggaacgacagacccatcccgtactgcggcaccgtaaatgaagcgagcgcgacaatgctgaccacgatgaccatgatggagctgacaatattcgcttcaacggccgcctggccgatgacgactccgcccaccaatccgatcgtctggccgagcgggctgggaagcctcaagcccgcttccctcagcagctcgattgtaatttccattaccatcgcttcaatgataggcgggaaggggacgttttctctgttcgccgcgatggtgactgcaagcgacgtcggcagcagcccttggtgaaacgaaacgagggcgatataaatggacgaaaaaaacagcgtgataaaaatagacgtaaacctgagcgcccggatgagcgaggcggaaatccaccgttcataataatcatcgggagactgcattaaaattcctaaagaagccggaaccaccagcgcaaacggcgagttgtcgacaaggatggcgacgcggccgttgaacaaggcggaagagactttatcaggccgttccgtattttgtatttgcggaaagggcgaatacttattatcctcaataagctcctcaagcgttccggaatcctggatgtcatccatcttcactttgctgaggcgctttacaacatcgctgacgacagacgggtccgccttatcatctatgtacatgaccgtggcgtattttaacttattttctccgatcggaacctttttcgttttcagcttcggatggttcgtgcgctgcctgatcatggcgatgtttgtatcagaatcttctatgaaggcgattttcggacctcttacgaccttttcggatgtgggttcatttacgcttcttttttctctttttcccgtggacaaaatgtatacgctgtcaagtccgttaataaacacggcgcattttccccgcagaatggagatgacggcttccttcgacgtaaagacgggacgggcgttgatcttatcaagacgtttcgccaccgtatccagcgtcagagtgtcttcctcctgaagcagcgtttcaatcgcctcttttattttgtcttcgtcgttcatttcactcagatacatataataaaaaacaagcccgttcggaagcatctttttattttgaaccaggtcatcattctgctctacgtggggaagcaccagtgccagattaacgtgtatgtattccttgaactccgattgcgtcatcgacagtcacccgccttccaatccttaattgaggttatcttttcctgttaaaaaaatgatatactatgataaagtatttaatggtacaagtttttttatgaaagcggaggagagatgtggcacaagtcagactggcaggaaatgccgaagaaattgaacagctcatcaaatcatttgaagcgcattacgaagtggcttacacgtcgaaagaataccgtaaaacaaatccgaagtataaatactctaaggattcgcgcgtctatcttgagctgaaattaaaaacggccaaggccgaaaaataaaaagggtttcatctgttactggcgaataatactcagggtgaagcaactgttatggagggatacataaatggactacagaattgaaaaagacaccatgggagaagttaaagttccggcagataaattttggggcgctcagacacagcgcagcaaagagaacttcaaaatcggttcagaaaaaatgcctcagcgtgttgtgaaggcgtttgcaatattgaaaagaagcacagcgatcgccaacgaacgcctcggcaacttagagtctgaaaaagcccaggcgattgccgctgtatgtgacgatgttttaaacggcaaatacgacgataactttccgctcgttgtctggcagacgggaagcggcacgcaaagcaacatgaacatgaatgaagtggtggccaaccgcgcgactgctttattgaaagaaaaaaattccgagctgaagattcatccgaatgatgacgttaaccgcagccaaagctcaaacgatacattcccgacggcgatgcacgttgcggcggttcttgccgtatatgagcagctcgttccggcgcttgatcagctgcgcgcgacgcttgatgaaaaagcgaaagcttatcaggatattgtgaaaatcggacgcacgcatttgcaggacgccactccgctgacgctcggacaggaaatcagcggctgggtatacatgcttgaccgttcgaaagaaatgattcttgagtcaacggaaaaaatccgcgcgcttgccatcggaggcacggcagtcggcacgggaatcaacgcccatccgcagttcggtgaattcgtcgcggaagaaatcacaaaagtaacggggcagacattcaagagttcgcctaacaaattccatgcgctcacaagccatgatgaaatcacttacgttcacggcgcgttaaaagcattggctgccgacctgatgaagattgccaacgatgtcagatggctggccagcggcccgcgctgcggaatcggcgaaatcgtcattcctgaaaatgagccgggaagctctatcatgccgggcaaagtcaacccgacgcaaagtgaggcgctgacaatgatcgccgcgcaagtgatgggaaatgacgcgacaatcgggtttgcggccagccaaggaaacttcgagctgaatgtcttcaaaccggttattatttataacttcctgcagaccgtgcagctgctcagtgacggaatgaattccttccatgacaaatgcgctgtcggtattgagccgaaccaagagacgattcaggaaaatctctctaactcattaatgcttgttacggcgcttaacccgcacatcggttatgaaaacgccgcgaaaatcgccaagcttgcccacaaagaaggcctgacactgaaagaagcggcattacagctgaaccttctgacagaagaacaatttaatgaaatggtgcgtccggaagatatggtgcacccgaaagcataaaagaaagaacggctgcagtcattgcggccgttcttctaaataaactgctgtttcagtaaaaatctgagctgttctgcatcttcagccagcaggtcggattccttcaaattcaaaatcattcctttgatgattgccggtttcggcgactttttcttcatttccgcttccagaatatccaagctctcggtgaattcagatgcttccgccttgtccatcgtgccgatgcgcgtgcggagggtctgcaagatcgattggcttaaaggatcgggctgcccgttatgaaggggcccaaacagtgagcttgcctcatcaagagaaataaatgcttcatcatgtctgcccgccattccgtttacgatgtcatcaattctgtgaatcacggtatttgccaaaagcgaaggctgtacggaccggccggtcagaatgagatattcaagatacatctgactgattccttctattaaaaaacaaagctcggctgtgtatggttcagctttttctccgtaaacagcaagaagactgtcgatatgaaactgcaggatcgaccggcggattctctttccgcactgcgccgcttcttcggtataaggaagtgaaccgtctttcatctgcatggtaataaaatcctgatgggcgagaatcgattcgtaaaacaccgcaagctgtttttgataagcggctctcggactgtcaccctccgtttggatcgtcgtgattcgggtaaacgttttatcatagtagtaattcagcatggataggagcagtgcttctttggaaggaaagtaaagataaaaagcgccttttgagattttgcattcatcggcgatttcctgaaccgatgtagatttgtacccttttcgggcaaacagtttgattgctgcttcaatgatcagcttttctttttccttcaatggttccaccctttcggagccaggaggctggcttgtgcttctcatgtatgactatatggtcatattgatattccgtaaatttaacctgattgtaacttgtttttttgttttgttttatttatattataaagtgagctgaccgaatggtcaaagttctggcgaaagggtgaatctgaaaatgaaagaattagatgaaatgatcagccgcttgcgaaacagaggaattaaagtcgaaaaggtgaaatatccgaaaaagacaatttgtgaaaagaaatgggttcatcaatgccaaaaaccgctgaaagcaaactacagagattttaacggctattccttcacataaaaaaagactgcaatgaaacactacagtctactttggtatgataattcggtagattacacccgattggtcattttcaattgaaattgatgctttatgcagggttaaaatccgttttacgatgctgagtcctatgccgaactcgcctttcttccctttattaaaaggctcgtacaagctggatagcatctcatcctcaatcggaggcccgtcatttttaaccgtcatgacaatctgctgctgattttggctgatccgaatgtgaatcgccgtttctgcatagcggatttgattttcaagaatgttttcaagaagtttgctccattgttccggatcaccgggcatcattaatgcatcttctgtatcaacgctccacaataattccttccgggcccatttgagccgttcaatgacttcttccgtgaccttcacaatgtcaaatgtctcatggtgcacccgctgcttcattaaataatcaagcttcgttaaatataataaatccttaattttcttctcaagtttttctgcttcgccttcaatgacatcaattgtggtttccagatcccccttaggaaaaatcccgtcctttattgattgagtatagccccttatcaccatgacaggcgtttttaaatcatgagagatattttgcaggagcgttctttccgtttcatccttttgcaccagcttgctccgcatgtcttcaatggtatggcctaattttccgatttcgtcttttctgtcgacgatgaccggatcatcccagtcctgttcggaaatccgtttgacatgcttctctaaggaaacgagcgggcgtgagagatatttggcaagccaaatcgccggaatccagcttaacaaaatcacgccggcaatgataaaaagcagctgcttgaacagggtgaatgccagatcatcacgataagaatcaagggcgtaagacagcatcatcgcatcctggccgttaatggtgaggccttttttaatgacgaaaaaaactttttcaccgctgatgtccgcgctgtatcgtttcgtgacgctgtgctggcggcccgcgagcttgtacaccttatggataaaggaagaagaaaaatagttcaagtctttgtcactggccgattcctcccgctccggcagaagaacgtgctgaacggatcggaaagtcgtcggagcggtcgcatcctcgctgtaatatccccgctcgatcgatccgggcagccggtactccgtcagtacatgctgttcattttcaatggtcgtatacgtttcatccgtgaaaaaattacgcagcgtatttgagaacagcacgagaagcagaatcgagatggctaagaggatgcctgagatgaccacccatatttgaaaagcaagcggcttatttttcatgacgtcatcatcctgtagccgaatccgtaaatggtctcaacctttaacccgggcattttttttctcagcctccgcacaaggtcatcgaccacccggtcagtgccgaaataatcatggccccatattttcagcaggatatcttctctggaaaaggggtgtcctttatggtgaagaaataaaagcagcagatcaaattccttagacgtcaaattgaccaggctgccggtttcatcataaacctcccgggcatcttcgatcacattgtaggaagaaacggtgatgccggttttctttgcggcgggctgttctttatacacgagctcgagcagtttctggacccgtataataagctctctcggcaaaaaaggcttggcgatataatcattgcttccaagctctaacccgaggactctgtcaatatcggcatcccgcgcggaaatgaaaatgaccggcacatcgggatctttttcttttatttcttttatcaatgtatagccgtccgtatccggaagcatgatgtcaagaatccacaagtggggagacggctgcatctgctttctggcatcttcgccttttgtgaaagatgtaatgttccagccttcattctctaaatattttgtgagcagttcattcaggttatcctcatcttcaactagataaatggtgtatgacaaggcatttcacatcctttcaacgtcattatactagttttaacatactcaagccgcattttcataatttcacatattcttttcatttttatcccacaatgtttgtttatgatgtgtataagggaagaaaggaagaaaaaaagcggggaagataacatgttcaaacacattttgttttggagctttgcttttctccttattattgggacaatagaacttgtacatgcgatgaatatgtaatcgatagaatgaaaacatgctgaaggagtgtgcgtgaatatgaacgatcatcgagatgacggcagaagccgcgatcagtcagatctttcacatacggaacaaaacagaaatgaacagcagcagatcagccatcaggagcccgagctgcttgaagggaccgtctcgaaagaaccggaaaacgagacggctgccggtacggaatttgaaaaaacggctgccgtgaaaaaagaaaaaaaacggagagccgcttggctgagcccgattttaggcggcattatcggcggaggcctcgtgcttggcattgtgccgaacctgccgggtgagcagcataagacagaagccgtttctgatacgaaacaagttcagtcttcgaattttacgtcaacgcctttgaaaaatacctcaagcgtagcggatatggtggaagaattggagcccgcgattgtcggagtgtccaactaccaagcttcgcaaagcagccagttcggacttgacggcggttcaagctctgaaacggaaagcggcacggggtcaggcgtcatcttcaaaaaagacggcgaaaaagcgtacatcattacaaacaatcatgtcgtagaaggggcgaacaaactgtcggtcactctttacaatgggaaaaccgaaacggcaaagcttgtcggaaaggatgccatcagtgacttggctgtattggaaatcagctcgtccaatgtcaaaaaagcggccagcttcggggattcctccaagctccgcattgccgataaagtgattgccatcggcaacccgctcggccagcagttttccggcaccgtcacacaaggtgtcatcagcgggctgaacagaacggtggacgccgatacatcccaaggcacggtggaaatgaacgtgattcagacggatgcggcgattaaccccggaaacagcggcggcccgttaatcaactcaagcggccaggtcatcgggatcaacagcatgaaagtcagtgaaaacggcgtggagtcgctcggctttgccattccgagcaatgatgtagaaccgatagtcgaccagctgcttgcaaaaggaaaagtcgagcgcccgtttttaggtgtgcagatgattgacatggcgcaagttccggaaacctatcaggaaaacacgctcggactgttcggcgaccagctgtctaagggtgtttacgtaaaagaagtgcaatccggctcaccggctgcgaaagcgggcatcaaatcaaatgacgtcattgtacaactgaacggcaaagatgtcgacagcagcgccgatatcagacagatcttatataaccagctgaaaatcggcgataaaacgactgttcaagtgctcagaagcggaagcaaaaagacgctgaacgtcacattaacgaaacaaactgaaagcgcaagctgagcgcataaaaaaagctgaaccttcaactgaggttcagcttttttcgtcattctcccaagtaggctgacagcatccacacatgcttgtccgcttcttcaactaatccgacaaacaggtcggcagttgacgggtcattttgttcctctgcgatgccgatgacaaattttgattcgcggctgatttgtttatagtcttgaaccagtgatttcaccatttcagaagccgttttttcctgaccttcatccgtaatggaagcttgttcaaggtaagtgtgcaaagtcgccgcaggctgtccgccgatggccagaagacgctctgcgatggcgtccgccgtttccgctgcttcgttatacagttcttcaaatttttcatgaagcgtaaagaagtgagggccttttacataccaatggaagcggtgcagtttagagtaaaggataaaccagtttgataattgtgtgttcattgatttctcaacaagagtttcagtttttttcgcgttttgtgtattcatattcatcgtcctccctgtgatctgttaatttaattatatcacgtatcaaataaaaatcaatactaaattataattattataatttagtttaagtgaacagctttttctttataatcgattcccaagcggaccacggaaagagtgagcggaaagccaatgtcagcttaacgcccctgccgatcggataccgcagtttcttcagccgtttcctttgtgccaattgataaatcagctccgctacgtcatcaggatcgccgcttttggatgcgttggctttgaagtaagcttcaaggggctgataaaagcgataataaggcgagtctttgccgggcgccgtaatatggctggagagagacgtctcccaaatagacgttttataggagcccggttctattaaagcggcatcaattcctaaaggcagaagctcgaggcgcagacactctgtaaacccttcaaccgcgaacttggaagagacatacggagatagagccgggaaaccggtcagtccgctgatactgctgatattgaagattttcgccccgccatgtttccgcatataaggcagcacggtttttgtgacgtgaatcagaccgaatacatttgtttcatactgctgtctgtaatgttccatcagcacatcttcaataaaccctccgtacgcagtgccggcgttattgacaagcagctcaatcggtccgaaaccgctgatggtgttcccgaagtcagacaccgactgctcatttgtcacatctaaagaaacgaccgtaatatatgcggatgcacccgcttgagcggcggcctctttcagtattacagctttctccggctgtctggctgttgcgatgacgtgataagaccgggcgagcttcagcgctgtcagcatcccgaatccgctcgtcgcaccggttacaatggcaacttttctgttcatcttataatcctccccgtttgtcgtttgttcttatctcatagtgtataacatctcgcggaaagaaggagaaatcgttcggaaatatgtcagaattgttttataatggagtcagcttcggatagaaaggggtaaagaaaagatggcattagagggattgaaggaaacatgggatttaaactccatttttgagggcgggagccggtcggaagagtttcagcaatacatacaagagctcaaaaagcatctaagcgcttttcaacatgcggttgaagcatttacagttccgacgcacgcggatgaaagccgggagctgatcaatctgattgataggtttgaacggtcagcgatcatgatcaggcaggcgggagcgttcgtcggctgtcttcaggctcagaacactcatgatcagaaagcgaatgaatggagagcgcggatcaatcagctgagcagtgattttaaatccgctctggtcacccttgacgatacacttgcccggattgacgagcgggtctgggaggagctcctgcaaaaaccggaacttcaggatctcacatatgttttaaatgagagaagagaccgggtcagagagaagctcagcgcttcagaagaaaggctgattgaaggcctggccgttgacggctatcacgcatggggcgacctgtataatgcggctgtcggcagaatgaagattccgtttgaggataaagagctgtcggtcggccaagcggaaaatatgatggcgcacccggatcgccgcatcagacgtcaagtgttcaaagagcttaatgaagcctggaaaggagaagaggagcttttcagcagcacgctgaaccatctggccggcttccgcacggaaatctataaagcgcggggctggaaaagcgctttggaagagccgcttgcgatcaatcggatgaaaaaagaaacgctggatgtcatgtggcaggtcattaccgatcataaaaagccttttgccgaatacctgaatcgaaaggcgtctcttttagggcttgagcggctgaactggtatgatgtgggcgcgccgatcggcgaggcttcgaaagaatacacatatgatgaagcggctaatctgatcgtcagccaattttcgacgtttggcaaaaagctgtccgcattcacggaaaaagcgttccgcgatcggtggatagaagcggaagaccgcagcggcaaacgggtcggcggtttctgcaccagctttcccgacagcggagaatcccggatttttatgacgttttccggaagcgcttcgaacgtatcgacgctggcgcatgagctcggtcacgcgtttcatcaggaggccatgctccaagtgcggcagctgaacagagcctacgctatgaatgtggctgaaacagcctcgacctttgcggaaatgatcgtcgccgacgccgctttgaaacaagcggagacaaaggatgaaaaggtgttcttgcttgaagataaaattcaaagaagcgtagccatgtttatgaatattcatgcgagatttttatttgaaacgcgtttttatgaagagcgcaagcagggcgtcgttccggctgagaaactgaatgaactgatggaagcggcgcagaaagaagcattttgcgattcattaggggaataccaccctcatttctgggcgtcaaaactgcattttcatattacgggagtgccgttctacaatttcccgtacacgttcggttatttattttcgcttggaatatatgcaagagctcttcgggaaaaagcggattttgaagaaaaatatatcgcgcttttgtgtgacacggcttcgatgaccgttgaggatttggcgatgaagcaccttggagcggatctcacggaacggtcgttttgggaagacgcggtccgccttgccgtacaggatgtgcaggaatttttagagctgactgaatgataatctggagatgaaccggccggagctgttaccgctccggttcttttttgttccgtgaatgacagccgcctcccttggaaatacctaaaaacgatcggaatggaatgggagtgaatcgcatgaaatggatcagaacggcgggcgttttatgtcttacgctgatgctgattgccggctgccgattgaatgaagaaaaacgggaagcggaacaagacagcacacctgtgtcatccgagaagccggttccttacagcagcttttccctgcgcgtcagctacggagccggagagcataaccgctatgaaggtttgtatgaaagaaaaagcggtcatgaaaaggcggacatccgggacaagctctcaggggttcacagagagggcgaggaagcgcttgatgaaatgaagatgatcctcggagaacttgccgtaaacggccggatgcaggaaagcgaggtcgtccgggaggtgctttcggcttttaatttggacagccgctatgaccatttttatctaaaactgaaaaagaacgatggagtaatgacggaaataaaaaaataaccgccgcccgctgcttttttacccaaaactaattgataatgatattcagagtcattaatttctgttacaatataatcatgatctcacgttgaatgtttaggcaatttgtttatatacatagtgttgggaaactcaaaaaaggagcggttagcggtatgagtgcaatttctacagagacgctgagcttagggtacggagagactgttatcattgacgaattggatgtcgcgattccaaaaggcgaaatcactgtattgatcggaagcaacggctgcggaaaatcgacgcttttacgttcattggcccggctgatgaaaccgaggggcggttctgtgcttttagaaggaaaagccatcgctaagcttccgacgaaggaagtggcaagagagctcgctattttgccgcagagtccgtcagctcccgaaggcctgacggtgcatcagcttgtgaagcagggaagatacccttatcaaagctggctgaagcaatggtccaaagaggacgaagacgcagtcacaaaagcgctaaaagcgacgaagcttgaggaaatggccgaccgtcctgtggattccttgtcaggcggacagcgccagcgtgcatggattgcgatgacactcgctcaggatacggatatcattctgcttgacgagccgacgacttatctcgacatgacgcatcaaattgaaattcttgatttgctgtttgaattaaatgaaaaagaaaaacgcacaatcgtcatggtgctgcacgatctcaatctggcatgccgttatgcccattatctggtcgccataaaggataaacagatttacgcagagggccgtcccgaagaagtcatcacttgcgagcttgtacagcaggtctttgcaatgaactgtcaggtaacgcaagatccgctgttcggcacgccgctttgcattccgcacggacgcggcagatgtatcgtgcaggaagcggccctcaccgcccgattgtcataatcatgaaaaagggaaggaaacggtatggaagaaaaactgcagcagcagctggacggcctgcttgagaaatacactgaactattgcttggcgaaacaaacccggatgtaaaggaagaagtcaggcagtggattttgtatacacatatcgcaaaaagcatgccgccgctcgtcaaacattggaatcaatcctacccggacgccaaagagggcatcaaagctgcgatacagcacattaaacagctcaatgaagctcacagaaaaaaacaataaaaagctttcggcatcaaagagaggtgccggaagctttttttgctgaaaaggaatcaataaaggcgccgttcaattcataacgaagaactttaatgtaactaacacacccgtttgtttacttgctgaaccaagaaaaaaggaccgccgcagcaatcccttactctttcctatatatcacatttcctttcggatacgtaataactcttcaaatgcttttatatttgtatcaaaattgggcactgtttgagattcctcggcacatttgacttgtgctacaaccaaatcattaaaaggtgttgaaattccagtaccttctgccattttgggaataactccattaatataatcaatttcagttttgcgttttttctcaagatcctgaagcatacttgctcttaaaagcctggatggttccatggctgccctaaatgtttgaatacgttcaggaatctcattttcactttttaattccaaagattctaaatcaaggccgcccattttcgcaaatgtgacaccattggcgtgtccaaccttaatcgtctcatctgcgatatgaactgcgctgacaatgccgatttcatggtcaagaatatcaccgtattctccgtttaatgctgccgataaaccactgaatgcattattgataagtaattttgaccacttcgttccaactaaattatcggaaatatgtgttccgccgataaggtctaaaaccgatttaatacgctggattctttctgttgtttcaccatttaattctccaatttgaaaagcgtactctttaaattgagtatactcagttgtaagtctggatacgcctggttcaataaacgtagcaccaaattcaacagaacctgcaataacacgttcaccaccaacgatcgaagcaactttctgttcaggtataccgttttgcaaggaacatactacactatcatcctttaaaaaaggcagtaactctttaagaatggagtcattatataattgtttcgtcaggagcaatatgaaatcatacttgcctgacttgttttcaggggtaatggcttttacctttgcctgaaatgccgttgtaccaactactttagcacctatttgatttaaagtatctacatgttctttgtatgaatcaattaattcgacatccattccgccagcagacagatatgctccaactatggttcctaaagaacctgctcctaaaattgcaattctcattgtaaacgtctccttatttttcctctaagtagttataaaccggctgtgctgcatttaaggttaaatccgtaataatatgagatgctgaaacgacttctaatacaggcaaatctgcaagaggcgccagagcatgttcaaataattgaagccgcgccggtccagaccaggcacctttaacttctatattcgttatttgcgtgcgcaccaaatcgcaaacccttaaatcaccattgtaatcagtagcaatcttaaccataaaattaggtcggcaaatttcccttttcgctttttccttgtccatttcgaaatgtttatatcccatagtcgcagctgccacacgaagactgccataatctaatgtgccaacgagagtatcagagtctatatacagcttaggggcgcccaatttctttggatatgcagtaagttcccgtccgcttgcaatagccgggaaattgtctacatacatagagtgtacataatctccttcttcaccattaaagctgacagggatgacttgtcctgcctctgtataggcaccaagtccggaaacatcgggcatccgcatcacttcgaatttcactaaaggttcagtaatttcaagaggttccggcactgccgcacgcaaagctttttcatccgttcggtaaataatatttaaatattcacggttaacaaatttataatttgggataggataagcaggagccgttagcggtgtatttaaattttttgctatatctttcacatcaattttcattgcatgacaccctttccttttctttaactatgctattatcttacatccgcatttacatttaatctaatacataataaggtatatatatatttattgaaataaataagggggatgcagacagatggaattgctgcagctaaaatactttcagacagttgcctatactgagcatatttctaaagcagcagaacaattaaagattgcccagccttctttaagtctcactataaaaagacttgagaatgaactgggaacagctttgtttgagagaaaaggcagaaatattaagctgagttcatcagggaaaattcttttaaaacatgtaaacaggatttttactgagattgaaaatgcacaaacggaaattcaattggaggaacatcaaatgtctgacaccatcagaatatctatttctaatccgagattccttgcaggactgatgagtgaatatatcaaccgctcccctcaatcaaaaattctccaagccatcggagttaaaagcgggatcctaacaagtttaaaaaaaggggacattgatttaggaataacaggtcatcctattcaagatgaagagatagaaagttgtatgctggtaaatgaagatattgttctggctttgccctcaaaccaccgatttacgggtaaaaccgaaatttctttacgtcttgtcgccgatgaaccatttattacccttgctaataatgaagagtatagcggttttacagcctcgctttgtgaaaaagccggtttcaccccaaatattgcatttgaggcggattctcatttactggccgagattataaagctggatcagggggtggcgttgcttcctatttcggtttgcagaacattggggctgaattttataaaagtgactgatcactctgcttcatatccagtcggcttatcttggatgaaacataagctgttatcttcttcggtaagaaattttcgtgactttattttgtcgtactataaagataactatgaaatgtttaaggtttattaaataattttcacccccgatttccaatgaggcggaagactggtcattcggaaacggagaggcccagatgatataaaaaaatcccgcggcatccgcgggatttttctttgttaaacggctttcgccttttcttcttgtttgcctgtctttttgtttgtcagcttaattgatttaacaaacagcgtgaggatcaatccggcagcgataaaggccaggcctgtgaaaaacacgctgtgaagcgaatccatcagtgacgttttcaaaaccggcacgatatgggaagaaaatgcggccgggatctgcttaatcgattcctgactgaacaaggattgaagcagcccttcaggatttttgtcaatcatacctttaaactgggcggcaaaggcacttgcctgtttcgggagtgagtctaagtaaggcaccagtctgtcggttaaaaggcttcctgatctggcattcatgacagcgccgagcaccgtaatgccgaacgttcccccgatcatccggaaaaattggcttgatgaagtcacaacgcccagctcttcttttgaaaacgtttcttgcagagcgagtgtgagaagcggcatgacgagccccattcccagaccgatcactgccatatagcacgtagccgcgagcttgcttgtatccagctgtaaggtcgttaataagaagaagccgacggccatgatcagcatgccgatcatgatttgcggtttaataccgatcttataaaccagctggcctccgataatacttgtgataatcatagataccatcatcggcgtcataatcgtgcctgacgcggtggcgctgactccgataattccctgcataaagaaaggaacgaacgtaacggcgccgaacatgccgatactcatgaaaaacccgatcagattcagtacggtaaacgttctgtttttaaacaggtacatcggcagaatcggttcttttgctttgatttcagcgaaaatgaatccgacaatcccggcaagcgcaagcgcaaagagaccgagaatctgccaagagccccatgcgtaatcttttcctccgaagctgagcgcgagaaggaggctgacgattccgacaatcattgtgaaaatgccggcgatgtcaaagttaatcggcccagtctgttttctgccttgaagtcctcttgcgataaagatcacggctaaaattccgacaggcaggttgatatagaaaacccatttccaatttaatgagtcaacaatccagcccccgatttgcgggccgataacggaagcaaggccgtaaatcgctccgaaaagcccttggaacttggcacgctgtttccctgtgaacaaatccccaatgacgatcatggccatcggcatcatgacaccgccgccgattccctgaagtccgcggaaaataatcagttccgtcatgttgctggccattccgcacagtgcggaagctcccataaaaatcaataaacctgacacatagacgacgcggcgccccaataaatctgcaagtttccccgcaatcggaacgatcgtcgtcgaagttaaaagatatgccgtggtcagccacgtcatcatgcttaatcccccgaggtcacccacgattttaggaatcgccgttcctacgatggtgccgtcaagggctgagaaaaacatggcgatgattaagcccgttattaataatgtgcgttttggatctttcttttcaatgctcatgtttcggcagctcctctttctattcgttttctttttgatcagccgcgtatttctcggcggcttccgctactttgcggatgatgttcacggactgaatcagttcatcgtcagtcagaacggacaggttacgcgccagtatcgctttccgtccttccacaacatcttcgaattttgtttcgccttttttggtgaggctgatgtcgatgacgcgtctgtcctgctggttatgtttgcggacgataagtcctttttgttcgaggcggtcggccatcagcgtaaccgcgctcggctttacctccatgcgttccgcaatttcggaaactttgcagctcccgtgttttttcaggctggctaaaacaaataattgggcaggcgtcacctcgtgttttgccatgctttccaccatttcaggctgtatgttttgcagcagcgtctgaagagatttctggatgtcagacacatattgatccgcgtttttcataactcctcctcatcttgttccttgagaaaataattaacattagttaaatataaataaggattaatgataagtcaatctttttgtgcaaaaataaaaaaaggactgatgcttggcgaaaacatcaaatcctttttcattttactgctggtagggagactgctgctgaatggtctgccggaacttctgatacgattgctgaagcttttgggtatcggcggcttcaatggaataccagccattttgaaacatcacatcgtataatcttctttgcgctttttgtgactcatcgaaaatcgcctgaatatcttgataaagagactcgtggctgaactcgtgcagggctgtgcaatatgaagccgtgatgtatttttccgtcgtcagcagctcattgaccaagtctctgtcattcatttgcgccgtattgggcacgggcgtttgcggattcgtgattttttgattttgctgttccatgtattgtcctcctattgcatatagcctgttgttgtctgtccgccttgaccggggttcaagcggcccaatatgtgctgataatgcttctcatgcatccggccgatctgatcaagctcttgttttaacgtctgattctggcagtgttccgccataaaatgcgcttttttcatggcaagcagattccagttcagcatgtcctcaagatacaaatggtctttcgttgagatgacggcaggcggcaagtttccgtgctgctcttggttgttcatataaacgcctccttcaattctgttctttttagctttctctgcgatcgggatttcatacagataaattaaaataaccacgatttgcaggagagacatcaatatttacaataaaaaaagacactatcagaagaaaaaaccttcggataatgtctgttcatgttaacagttcgatatatgcgaaagtcagcagcggcactaggattggacttcagctgccggtttattgtctagatcagtgccggcttttctttcagttatttttatttttggtaaaagaaaagcagaaaatactccggcaattaatagtataagccctgcgaaaaatacactgcgaagagagtccattaacgctgtcttcattatcggtatgatgtgctttgctatagaatgcggaaattgttcgaatgaaccagaactgaatagcctctgtagcaggacttgaggattgctgctgatcaagtctttgagatgagctgctaatgcgttttcttgttttggaaaattgtctaaaaaaggaactaatttatcggttaatatatttcctgacttggcattcatcactgctcccagaatcgtaattccaaacgtacctccgatagagcggaaaaattggcttgacgaagtaaccacgccgagcgtttctttagagaaactctcttgaagtgccagagtaataatgggcataacaaggcccataccgaagccgatgatagctacataagtagttgcagttaatttgctggtgtcagcttctaatgtggataataaaaaataggcaaaggatatgattgccatccccgtgataatctgcgctttaatgccgattttaaagaccagctgcccgcctataatactggagataatcattgcgaccatcatcggcatcatgattgtcccggactctgatgcactcatgccgattattccttgcatgaagaaagggacgaaggtgattgctgcaaacatcccaatactcataaagaaccctattaaatttaagaagataaaagttctgctttttagaagatgtataggcagaattggttctgcagcttttttttctgcaaatacaaaactaataatacttatagtggccaaagctaacagacaaaatgtctgccatgataaccagtcaaattcttttccgccgaaactgagtgtaagcagcaaacagactacacccgtaatcattgtaaacatcccgatgaagtcaaaatgaatcggacccgtgtattttctggcctgcaatcccatcgcaataaagaacacagctaccattcccacgggtaaattgataaaaaatacccaatgccagctgaaagaatctacaatccatcccccaatttgcggaccgattacagaagcaagagcgtaaataccgccaaatacgccttgaaatctggcacgctgtttgcctgtgaataaatctccaatgacaatcatagccatcggcatcataatgcctccgccaagaccttgtaaacctcgaaacacaattaattctttcatgttatcagccaggccgcacagtgaagagccaatcatgaatataatcagcccggccacatatactgcccggcgccctaatagatctgcaagttttccagcgatcggaacgatggaggtagatgttaataggtaggccgtagtcagccaagtcatcatgctcaggccgccgagatctcctacaatcttaggcataaccgttcctacgattgttccgtccagagcagaaaaaaacatagctataataagtccaattaataaaagtgtacgtttagattttcctgttgaatccaattgaaggttccctcttttcatatgtttcgagcttagtgattcttcaaaataaggtgaatggataactcaggcaggtcccttctttaaattccgttagggaagagaagccatctttaaagatgaaggatcgtaaagctattagaaagaaataataatgctttggaggtatgtttgtgaggcaaagataaattcagcagaattatcattttgaaattctgcttttccttcttaatagatacgttcaataaactgaattatcaattttaaatataagccattgtaaattataaatcaattatcttttaaggaatattttcaaattataaggggataaagaaatataaattataagtttttttgggcgaaatgtaacgaagaagcggaattatagctcgaaaactcaattgaagaagtagtgatttttattgatcctttttgtgactcattaaaaccgtttgaatatcttgataatataatacattgctttgacatcagagtctgtatggatatatgaatgatatcttggcaatctgcatggcttttgtgttttagctttctctgcgatcggaaattcatacacgaataaaagaaaaaggagggagttcatccttgctgcggagcatatgtttatttttgtcgaaaaataaaatgcttacaaaattcgcccaggcttacggaatccgcttcggcgcgggaaggttcgttgcaggggaaacgctcacggaagctgtgaaaacggtaaagcggctgaaccaaaaagggctgtcggcttcgattgattatctaggtgaatatgcgggttcagagaaggatgcgaaaaagacggcggaagaatgtaaaaaagcaatcagggcgattgccgagaatcaactggattgtgagctgtcgctgaaattaacatccatcggtctggatatttccgaggaactcgcggaacagcatgtcagagacatattgacggaggcaaaagaacgcggcgtgcctgtaacgattgatatggaggactattcaagatgcggccgtacgcttgagctgtataagcggtgcaagccggattttccgatgctcggcaccgtcattcaggcttatttataccgcgcagctgaagacatcagcggtctgatgccatataagccgcggctcaggcttgtaaaaggcgcttataaagaatcggcggccgttgcgttccctgataaaaaagcaaccgatcttcattttcagcagctgattaagctgcagcttttgagcggctatgaaacggcggtggcgacacatgatgacgatattatttcgtatacgaaaacactcatcagcgagcatcagattccccgggagcagtttgaattccaaatgctgtacggcatcagaacggagcgccagaaggagcttgccgaagaaggatacaggatgagggtgtatgtcccgtacggaaccgattggtacgggtacctgatgagaagaattgccgagcgcccggcaaatgcggcgtttgtgctgaaaggaatcttcaaaaaataacggctgctccaaaaagcagccgcagtatgttattccatgttgtcttttttatattgctgattttggctcgtccgtttgccgccgccgtatttttgcttcggtcccgcatttcctttcatgctggccgcgctcactgcggcagaagacggatcttttctccctcgcaccattcccttcacctccgggtttaagtttcccgcccgcgccatggaacatgcggaagccgaaaaatttaaaaaaattccatatttgctattgaagtcatcctgaaaatcttttaagatgaaagaagaaaagggtttcattttttttgccgaaaaaatgaatgactattcattcaaagttcaagggggatgactcatgcacaagtttataaagaaagcagccgttctcggatcaggcgtcatggggtccggaattgccgcgcacttggctaacatcggaattcccgtcctgctgcttgatattgtgccaaacgagctgacaaaggatgagatgaaaaaagggctgacattagaaagcccggaggtccgcagcagactgagccgatcggccatgcaaaagctgctgaagcaaaaaccggcgccgctgacttcggctgccaatctcgactatataacggcggggaatttggaagatgacgcagctcaattgaaggatgctgattggattattgaagtcgtcgtcgaaaaccttgacgtaaaaaaacagattttctcactcgttgatgaataccggaaaccgggaagcatcgtgtcgagcaatacgtccggtatctccgtcacaaaaatggcggaaggccgatctgccgattttaaggctcatttcttaggaacccatttctttaatccggcccgctacttgaagcttctggaaatcattccgattcaggaaacagatcctgacgtgctggagtttatgacttcatttgcagaaaacacgcttgggaaaggtgtcgtcatcgcaaaagacacgccaaactttatcgccaaccgcatcggtacgtacggcctgctggtcacggtaagagaaatgctttcttccggctgccgcatcggcgaggtggacacggtgaccggacctttgatcggcagaccgaaaagcgcgaccttcagaacccttgacgttgtggggcttgatactttcgctcatgtggcaaaaaacgtatatgataaagccgacggcgctgaaaaagacatgtttaagcttcctgaatttatgaatgacatgctgaaaaacaattggctgggcagcaaatcaggccaaggtttttacaaaaaagaaggtaaaacaatatatgaactcgatccgctgaccatgacatacggtgagcgctcgaaaatgaagacgcccgctttagaagccgccaaacaggcaaagggtgccaaaggcaaaatgaaagcgcttgtatattccgatgaccgcgccggacgcctgctttggaatatcacatcgcaaacactcttatactcagcccggcttttaggtgagatcgctgatgatataaaagcaattgatgacgccatgaaatggggcttcggatgggagctcggaccgtttgagatgtgggatgccatcggcgtcagaaaatcagcggagcggctcgaagaagaaggcgcagcactccccggctgggtgaaagaaatgcttgatcagggtcatgaaacattttatatgaaggaaaacggaacacaattttattattcagacggccaatacagggctgtgaaagaaaatccgaaacggatcagcctgcagacgttaaaagaaacaaaaggcgttatcactaaaaacagcggcgcaagtctggttgatctcggcgatgatgtcgcgctgctggaatttcatacgaaaagcaacgcgatcggcttagacattattcagatgattgacaatgcgcttgaggaaacggagcggaattataaaggtcttgtcatcggaaaccaaggcagacatttctgcgcgggagcaaaccttgcgatgattttaatggaagcccaggatgataacttcatggaagtcgattttgtcatccgccgttttcagcagacgatgctgaacatcaaatacagcgctaaaccggttgtagcggcgccattcgggatgacactcggcggcggcacggaagtctgtctcccggcggcacgcgttcaggcggcgagcgaatcgtatatgggtctcgttgaaaccggcgtcggtcttattccgggcggcggaggaaacaaagagctgtacatgaattatctggacggcggaagtgaactcatggacgcagcgattaaaaccttcgaaacaatcgcgcttgccaaggtgtccggttcggcacacgaagcccgtgacatgaagattttgtccgcggcagaccgtatcagcatgaatcaggatcacctgctgcacgatgcgaaacagctggctgcttccttatatgacagcggataccgtccgcctgcccgcaaaaaagtgaaagtcaccggagaaaccggctgtgcggcattactgctcggagcagaccaaatgagacggtcgggttatttatccgatcacgatatgaagattgcgaagaagctggcccatgtcattgccggcggaagagtcccgttcggcacggaggtttcagaagaatatttactcgagattgaaagagaagcctttttaagcctcgctggcgaggcgaaatctcaagcgagaatgcagcatatgctcgtcaaaggcaaacctttacggaactaggagggtgtttatgagagaagcagtcattgtggccggtgcgagaaccccggtcggtaaagcgaaaaaaggatcgcttgcagccgttcgtcctgatgatttaggcgcgctttgtgtaaaagaaacgctgaaacgggcaggcggctatgaaggaaatatcgatgacttaattatcggatgtgcaacacctgaagccgaacaaggattaaatatggctcggaatatcggtgcgctggcggggcttcctcatacggtgccggccattacggtgaaccgctactgctcttccgggctccaatccatcgcttacggtgctgaaaaaattatgatcggcgcgggtgataccgtcattgcgggcggtgcggaatccatgtcgcaagttccgatgatggggcatgtgacacggccgaatatcgctttggcggagcatgcgcctgagtattacatgagcatggggcatacggcggagcaggtcgccgaaacgtacggagtatccagagaagaccaggatgcatttgcagtccgcagccatcagaatgccgcaaaagcccttaaggaagggaaattcaatgacgaaatcgtgccggttgaagtatcgctgacagaagtcggtgatgaccataagccgcggaaaaaacaatttaccttttctcaggatgaaggcgttcgtcccggcacgtcggctgacgtcttggcgaagctccgcccggctttttcaaaaacgggaaccgtgacggccgggaactcttcacaaacaagtgacggcgcggcggctgtcatgctgatggatcgcgaaaaagcatcgtcgcttggattggccccgcttgtcaaattccgttcctttgccgtaggcggcgttccgcctgaagtaatggggatcggtccgattgaagccattccgcgggcgctcaagcttgccggactcgaattacaggatatcgggctttttgaattgaatgaggcctttgcttcacaggccattcaagtgatcagatcgctcgggatagatgaagaaaaggtgaacgtcaacggaggcgccatcgcgctcggacatccgctcggctgcacggggacgaagctgaccctgtcactcattcatgaaatgaaacggagaaacgagcaattcggcgttgtgacgatgtgcatcggaggcggcatgggcgctgccggcgtatttgaactcatttaaaaaaagggggaaatgaacatgaaacaggaaacggtcaacgtcaaaaaaggcggcagctttctgattgaagagacgggatatgatcaaatattcactccggaggactttacagacgaacataaaatgatcggcaaaacgacagaagactatgtcgtaaacgatgtgcttccttatatcgatgaaattgaaaaccatcagtttgagcattcggtcagactgctgagaaaagccggagatctcggcctcctcggagcagacgtgcctgaagagtacggcggaatcggcctggataaaatcagttcagccttcattacggaaaagttttcacgtgccggcagcttttcgctatcttacggcgctcacgtcgggatcggttcattgccgatcgtgttcttcggaacggaagaacagaaaaaaacctatttgccggacttggcttcaggacaaagaatcgcggcatacgccttaactgagcccggttcaggttcagatgccctcggcgcgaaaacgacggctgttttgaatgaagcgggcacacactatattcttaacggagaaaagcaatggattacaaactccgcctttgcagatgtctttgtcgtctacgctaaagtggacggagataagttttccgcatttatcgtagaaaagaactatccgggcgtatcaacgggaccggaagagaaaaaaatggggattaagggttcatcgacaagaacgctgattttagatcaggcggaagtcccgaaagaaaatcttctcggcgaaatcggaaaaggccatgtcatcgcctttaatatcctgaatatcgggcgctacaagcttgccgtcggcacaatcggcgcttcaaaacgggtgattgagctgtctgccgcttatgcaaaccagcgccggcaatttaaaacgccgatctcaagcttcacgctcactcaggaaaagcttgcgacgatgtcagcgcggctttacgccatggagagctctgtatacagaacagtgggcttattcgaagataatatgagcagactgacggaagaggagcaaaaagacggacgcgaagtcgcgaagtccatcgccgagtacgcgattgaatgctcgctcaacaaaatgtgcggttctgaaacgcttgattacattgccgacgaaggggttcaaattcacggcggttacggatttatgcaggaatatgaagtggagcgcgcctatcgcgactcaagaatcaacaggatttttgaaggcacaaatgaaatcaaccgcctgatcgtaacgagcacgtttctgaaaaaagccgtaaaaggtcagctgccgctctttgaaaaagcaaaagcgctccaagaagaactcatgatgctgatgcctgaagagccgggctcagaacctcttgaacaggaaaaatacattgtcagacaggcgaaaaagatcgccctcttgacagcgggtctcgcggcgcagaaatacggcaaagagattgaaggcgagcaggaaatcatggtgaacattgccgatattgtcagcgcgctgtatgctttggaatctgccgtcctcagaacggaaaaagcaattgcggcggacggtgccgaaaaagccgcgcagaagctgttatatacggaaatctttgcccaggaagcccttcagaacattgaagcgcacgccaaagaatcactgatcgccatggaggaaggagattccctccgcatgatgctttccgtgctgcgcaaactgacgcgcctgacgccgaaaaacctcattcagaaaaaacgtgaagcggcagcagccgtcttccgtgaagaaaaatatacagtctgatcacatgctgaaagcgctccttcatcaggggcgctttttcatgaagcaacgttataggtttttacaagtgattgtgttaaaataacgacgatcatttacaaggggtgaagaagatgtcgttaaatttttactggtaccctaaatgcggaacgtgccgtaatgcgaaaaaatggctggaagaccgcggtaaggaaataaacgaaatacatatcgcggaggaaactccgtcgaaagaagaaattaaagacctctatgaaaagagcggtcttgagctcaaaaagtttttcaacacgagcggaatgaaataccgcgagctgaacttaaaggaaaaactgtaccatatgtcagaggatgaacagctcgaacttctggcatcagacggtatgctcctgaaacgcccgattacgacagacggcgaaaaagtcactgtcggctttaaagaagaccaattcgaaaaatattggatgtaatgccaggttcaaagaattatggtatcttcttattataagaaaaaaatggagggatttagatgagcacaccgaaagatatgcgttattccaaagagcacgaatgggtcaaagttgaggacggaaaagcccgtatcgggattacacatttcgcgcaagccgaacttggcgacatcgtatttgtcgagcttccggaagtcggcgccgaaattaaagcggacgagccattcggcagcgtggaatccgtcaaaaccgtatccgaactgtacgcaccgattaacggaacggtgacggaagtgaacgaagaccttgatgacagtcctgaattcgtaaacgagtctccgtatgaaaaagcgtggatgatcgtcgtggaaccggctgatgctgaagaaatcgaaaacctcatgacttctgagcaatatgacgaaatgacacaggaagactgatcggatagcaaaggggccatttggacactctatctgtaacgggaggtgtctaaaatggcttttgataaacaaaaggtcgatgtgacggagaacgtcacgggccgctttcaaaacggccggttttccttgtttcatgaaaatgaagccatcggcgagatgacaggcatggaccagtacgagctcaaacagggcttttcatttgaaaatcaaaaattttataaaacagccgatgtcataaacggcagcgatccgaaatatgtcgattgcgattatgagaatggctggtgttaacagttggcggtgaatttcactgccttctttttcaatctgacgctaaaacaatcggcaggtgacgcgcttatgtacaacggagatgaaaaggtcattatcgtagaaggaaaatctgataaaatcaaagtcagggaagtgctcatcgaacccgcggaaatcgtctgtacaaacgggacgatcggccaaaccgaactggaagagttggcggaccgcctgtttgacagagacgtctatattttaacggacgcagatgactccggagaaaaattaagaaaacagctgaaacgggagcttcccgaagcgcgccatatttatatagacagaacatacaggcaagtcgagtcgtgcccgggccatcatctcgcatctgtgctgatcagagccggctttgatgctgacactgtatttttgaaaaagaacgacctgaggtggtaatcatgaaagaactccaagaaaatgaactcgaatcgattcaggatgacgtttatctcctgtatttgtacaccccgttttgcggcacatgccagctggcgtccaaaatgcttactgtcgtcgaagaaatgctgcccggtgccgccttctataaaaacaacgtgaattattcccccgcattcgccaaagcctatcagattgaaagcgttccgtgctttttgctgtttaaaggcggagagcttgttgagaaaggatacgccttccgctccgtttcctatttatatgagctgattaaacaaaaaacatcgcaaacgttcccgatgtgacaatatttacaggaaaatgtcgtgcggtttataaagggttctgtccgttaaaaagagaaagtgtatgtatggccattaaaacgggaggttatacgagtggagaaaatagaagtttcagagaatgacggacagcatctgtttttgaaaccgctattaaacgcctcaacgctgctgattacattccaaggagaaacagaagccttaacggtctcaattaacggacagggagaaatgagaaaaacgtcggcttcaaaggagaaatctaatttgaccttttacggaaaccagacggaaatcatccatctcctgcatggtgatgtctctttgcaaaagcttatccaaagcggaaaactcaaagtgaaaggatcattcagagccctgctgaagctggaggccatcctctggctgacaaacggattttttcaggcgatcagtaaacggccgtaactgccaatctactatgtgacaatagcttccaatatttattttattgactttttatcattcgccgtgctattctacagtaagaatttccggacgaaaatacgatatgttttctcttatcaagagaggtggagggaagtgccctatgaagcccggcaaccatcaacaatgttgaaatggtgccaattcactcaaagcggtctgctttgaaagatgagagaaaggcctttttcaataagcctttctgctcatttttgcagaaaggcttttcttttgcggagaaacccggaagatttcttagaatagtgtaaggcgggtgattgctttgatccatcttcaaaatgtttcaaaaatttacaaagcgaagcatggggatgtcaatgctgtccaagatgtcactcttgatatcaaaaagggcgaaatatttggaattataggatatagcggagctggtaaaagttccttaatccgtctcctgaacggccttgaaaagccgacgtcgggaaccgtggaagtcgcggggacggaattaaataaagtaagcagccgcgggctgagaaaagcgcgccaggaaatcagcatgatcttccagcattttaaccttttgtggtcgcgcaccgtccgggagaacattatgttcccgctggaaatcgccggcgtgaaaaaaagcgaacgggtccgccgcgctgatgaattgattaaactggtcggattagaggggaaagaaaaatcttatccgtcgcagctgagcggcggtcaaaagcagcgtgtcggcatcgcccgggcgctcgccaataatccgaaagtccttctgtgcgatgaagcgacatcagcgctcgatccgcagacgaccgattcaattttggatcttttatccgatataaatgacagactcggtctgacgatcgtgctcattacccatgaaatgcacgtcatccgaaaaatctgcaacagagtcgccgtcatggaaaacgggaaagtcgttgaagaaggcgaagtactccaagttttcagaaacccgcgcgaaccgatgaccaagcgtttcgttcagcaggtgacagaaccggaggagacgaaagaaaccatccagcattttctgcaggaaacagcgacagggaaaacgattcagctttcatttgtcgggcaggccgccgagcagcccctcattacggaaatgatccgaaactttgatgtggacgtcaatattctgcaggggaaaatttcacagacgaaggacggagcttacggttcattattcattcatattgacggtcaggaaaaagaagtagaaaacgtgatccggttcatcaaagacaaacaggtagaagcagaggtgatcacaaatgtttgaaaaatggttcccgaacgttgatataaccgagctgtggacggccacatatgagaccctttatatgacggtcatcgctttagttttttcatttatcatcggagcgattctcggtcttctgctctttttaacgggcaagggaagcttatgggaaaataaaatcattaacaccgtgattgcggcggtcgttaatattttcaggtctattccgtttcttattttaattattctgcttctcggctttactaagattctggtcggatcgattttaggaccgaatgccgcattgccggcgctgattatcggctccgcgccgttttacgcccgtcttgcggaaattgcgctccgggaagtcgataaaggagtcatcgaagctgccagatcaatgggagcaaagacatcgacgattatcttcaaagtgctgattcctgaatcaatgcctgcgttaatttcaggcatcaccgtgacggccatcgccctgatcggatctaccgccattgccggcgccatcggttcaggcggactcggaaaccttgcatatgtagaaggctaccagtccaataatacggatgtaacgtttgtagcgacagtatttatactcatcatcgtctttatcattcagattatcggtgatgtaattacaaatataatagacaaaagataagggaggatttacattgaaaaagattgtattaagtgcgctgctgcttgtgttcgcgggagttttagccgcctgcggatcaaacggctcgaataaaaaggaaatcgttgtcgccgcgacaaaaacaccgcatgctgaaatcttaaaagaagcggaaccgctcttgaaggaaaaaggctacacattaaaagtaaaagtgctgaacgattacaaaatgtacaacaaagcgttagctgataatgaagtggatgcgaactacttccagcacgttccttaccttgaacaggaaatgaaagaaaataaagattacaaactcgtgaatgccggagccgttcaccttgagccgttcggagtttacacgaaaaaatacaaatcactgaaagacctgcctaaaggcgcgaccatcatcatgactaacaatgtcgctgaacaaggccgtatgctggcgatgcttgaaaaagccggactgatcacacttgatccgaaggtaaaaacgattgaagcgactacgaaaaacattacgaaaaacccgaaaaacctgacattcaaaaaaatcgcccctgaattaacggcgaaagcatataatgaagaagaaggcgatgcagtcttcattaacgtcaactatgcgattcaaaacaaactgaatccgttaaaagatgcgattcaagtggaatcaacgaaaaacaacccgtacgcaaacatcatcgccgtacgcaaaggtgacgaaaaatcagagaaaatcaaagcgcttatggaagtccttcactctaagaaaatcaaagactttattgagaaaaaatacgacggagccgtgcttcccgtatctgaataaagcgaaaaccccggatgaatcatccggggtttttttcgggtattaatcggagaactgtccataataaaaaggaaggttaacgattggagggaatggcagtggctcaataccaggataacggaaaaagcgtgcatgacgcattgaaacaatataaagaaggtttaggcatattcgagcaaaaaatgcccatgatggggcggaagtttaatgaatttactgagcagtgtttctcagcggattcattaactgaaaaagagaaacaattaatcgctctgggcatcagcatcagcgctcaagatgaattttgcatgatttatcatacgaagggctgccttgaccaaggggccacagaagaaaacatccttgaggtcatcagcgtcgcggcggcattcgggggcggcgcggctctcagtcagggagtgaccctcgtgcagcagtgtattcaggaattcggacatacgacgcattagaatgagcaatcgtgtgaataccgtttttcagataaagcgagcgccggtttccggcacattcgaaaggattcaggggcacaccctctttggccggagcagcggatcattgttacaatagaaacaaatatatgaagggattgattcattatctgcaccagccacgagagactggaccttgactatacgcctgaaatggaaaaagcgatgcagaagtcacacggcatcggctacgaggaatacggacggcgtctttcaaaaaggatggaagtcgaacggcagagggagcttgaatatcaaaaaagcaagttcctcgcagcgcagcttaatgagaaaatcggtcagtaaaaaagggtggatttccgccctttttctgtttcaaacagctttaattacgccttgatctttgataaactttaggaatgttccgggtaatataaaaagttgtatttacttttcatttgttataaaattagaatgagaataaattgagaataatgattatatattttggaggtatagatatggctgcttcaacattaacgatcaaggatcttcacgttgaaatcgaaggaaaagagatcttaaaaggtgtaaaccttgaaataaaaggcggcgaattccacgctgtcatggggccgaacggtaccggtaaatccacgctctcagcagcgattatgggacacccgaaatacgaagttacaaaaggaagcatcacgcttgacggcaaagatgtactggaaatggaagtggacgagcgcgctcaggcgggtcttttccttgcgatgcagtacccaagcgaaatcagcggtgtgacaaatgccgatttccttcgctctgcgattaacgcacgccgtgaagaaggcgatgaaatttctcttatgaaattcatccgcaaaatggacgaaaacatggagttccttgaaatggaccctgaaatggcgcagcgttacctgaacgaaggtttctcaggcggggagaaaaaacgcaacgaaatccttcagcttatgatgatcgagccgaaaatcgccattcttgacgagatcgattcaggtcttgatatcgatgcgcttaaagtcgtttctaaaggaatcaacaaaatgcgcagcgaaaacttcggctgcttaatgatcactcactaccagcgccttctgaactacatcacgcctgatgtcgttcacgttatgatgcaaggacgcgtagtgaaatccggcggcgcggagcttgcacagcgccttgaagcggaaggttatgactggattaaacaggaactaggcattgaagacgaaactgtaggccaagaagcgtaagcgttagggggataatcatgacattggaaacgaaactatccgtagatcaggaatatgtcaaaggcttttccgaaaagcatcaagaacctgcctggctgaaaaacctgcgcttacaggctcttgaaaaagctgaagatctgccgctgcctaagcctgataaaacaaaaatcacaaattggaactttacaaagttcaacaagcatacagtagaaaacgcgccgcttgcttctttagaagatttagctgatgaagcaaaagcgctgatcgatatcgaaaacgaagataaaacgttatatgtgcagcgtgatcaaacgcctgctttcctttctctttcaaaagaactgaaagacaaaggcgttattttcacggacatcttaacggctgcccgtgagcacagcgacctcgttgagaaatacttcatgaaagacggcgtaaaggtcgacgagcataaactgactgcgcttcatgcggcattaatgaacggcggggcattcctttatgttcctaaaaacgttcaggtggagacgcctgttcaggccgtttacgttcatgaaagcaatgacacggcattgttcaaccacgtgctgatcgtcgctgaagaccacagctccgtcacttacgttgagaactacatcagcacggtgaatccgaaagaagcggtattcaacattatcagtgaagtggtcacaggtgataatgccagcgtgacgtacggcgccgttgacaacctgtcagcaggtgtcacaacatacgtcaaccgccgcggagccgcgcgcggacgagacagcaaaatcgagtgggcgctcggactgatgaacgacggcgacacgatttctgaaaacacgacaaacctctacggagacggcacatacggcgatacgaaaaccgtagttgtcggaagaggagaacagacggaaaactttacgacgcagatcatccacttcggtaaggcttctgaaggctatatcctgaagcacggagtcatgaaagatgccgcatcttccatctttaacggaatcggcaaaatcgagcacggcgcgtctaaagcaaacgctgaacaggaatcccgcgtcctgatgctgagtgaaaaagcacgcggagatgcaaacccgattctcttaattgatgaagacgatgtaactgcaggacatgcggcatctgtcggccgtgtggatccgatccagctttactacttaatgagccgcggaattccgaaagaagaagcggagcgcttagtcatttacggattccttgctccggtggtaaaagagcttccgattgaaggagttaagaaacagctcgtctccgtcatcgaaaggaaagtaaaataatgaatatcaccgatattcgtgaacagttcccgatccttcatcagcaagtgaacggacatgacctcgtgtaccttgacagcgcggcgacttcccagaagccgcgtgctgtcattgaagcagtggatcagtattacagcaaatacaattccaatgtccacagaggcgttcatactcttggcacgagagcgacagacggctatgaaggtgcgcgtgaaaaagtccgtaagtttatcaatgcgaagtcaatggctgaggtcattttcacaaaaggcacgacaacttcactgaatatggtggcgctgagctatgcccgcgccagcttaaaacccggtgatgaagtggtcatcacccaaatggagcatcatgcgaatatcattccgtggcagcaggcagtaaaagcaaccggcgcgactttaaaatatatcccgatgcaggaagacggcacgctttcgctggacgacgtccggcagactgtcacaagccatacgaagatcgtggcagtcgctcatgtgtcaaacgtgctcggcacgattaacccgattaaagagatcgccaaaatcgctcatgacaatggcgctgtcatcgtggtggacggggcgcagagcacaccgcacatgaaaattgacgttcaggacctggattgcgacttcttcgcgctttcttcccataaaatgtgcggcccgacgggaatcggcgtgctgtacggcaagaaagaactgcttgagaatatggaaccggccgaatttggcggcgaaatgatcgactttgtagggctttatgaatcaacttggaaagagcttccgtggaaatttgaagcaggcacgccgattatcgcaggcgcgatcggattgggagccgcgattgattttcttgaagagatcggactcgacgagatttcccggcatgagcataagcttgcagcctatgcgcttgaccgtttcgagcagctggacggcgtgacggtatacggtccgaaagagcgggcgggacttgtgacatttaatcttgatgaggttcaccctcatgatgtcgcgactgtcctcgatgctgagggcattgcggtcagagccggccatcattgcgcccagccgctcatgaaatggctggatgtatctgctactgcgagagcgagtttttatctgtataatacagaggaagagatcgataagctcgcggaagccctccaaaagacaaaggagtactttacaaatgtcttttaatgcaaatttagatacattatacagacaagtgatcatggatcattacaaaaatccgcgcaacaaaggggttttggatgacagcatcgtcgtcgatatgaacaacccgacttgcggcgaccggatcagactgacaatgaagcttgacggcgataccgttcaggaagcgaagtttgaaggggaaggctgttccatctccatggcttcagcttccatgatgacgcaggccattaaaggaaaagatattgataccgccctttccatgtctaagattttctcagacatgatgcaagggaaagagtatgacgactcaatagatctcggggatattgaagcccttcaaggcgtttcgaaattcccggcccggattaaatgtgccaccctttcatggaaagcacttgaaaaaggagtcgctggcgaaaaaggcggcaattaaaagattggagtgaaaatggatggctaaaaaaatgcctgaaattggtgaatacaagtacggttttcacgataaggacgtttccattttccgttcagagcgcggattgacaaaagaaatcgtagaagaaatttcacgcatgaaagaagagcctcaatggatgcttgatttccgcctgaaatctcttgagcatttctacaacatgccgatgccgcagtggggcggggatttaaactctttaaactttgacgaaattacgtattacgtaaagccgtctgagcgttcagagcgttcttgggatgaagtgcctgaggaaattaaacagacatttgacaaactcggtattcctgaagctgagcaaaaataccttgccggtgtttctgcacagtacgaatccgaagttgtgtaccacaatatgaaagaagatcttgaagcgcaaggcattgtcttcaaagacacagacagcgcgctgaaagaaaatgaagacattttccgcgagcactgggcgaaagtcattccgccgactgataacaagtttgcggcgctgaactcagctgtttggtccggcggatctttcatctacgtgcctaaaggcgtgaaggttgaaacaccgcttcaagcttacttccgcatcaactctgaaaacatgggtcagttcgaacgtacgctgatcatcgttgacgaagaagcaagcgttcattacgtagagggctgtacggctcctgtgtacacaacaaactcgcttcacagcgcggttgttgaaatcatcgtcaaaaaaggcggctactgccgttatacaacaattcaaaactgggcgaacaacgtttacaacttagtaacgaaacgtacggtttgtgaagaaaacgcgacgatggaatgggttgacggaaacatcggttctaaattaacgatgaaatatccggctgtcattctgaaaggtgaaggcgcgcgcggcatgacgctctctatcgctcttgcgggcaaaggacagcatcaggacgcaggtgcgaaaatgattcaccttgcaccgaatacgtcatccacaatcgtatcaaaatcgatttcgaaacagggcggaaaagtaacataccgcggtatcgtccacttcggacggaaagcggacggcgcccgttcaaacatcgagtgtgatacgctcattatggataataaatcaacttctgatacaatcccttacaatgaaatcctgaacgacaacatttcattggagcacgaagcgaaagtatcaaaagtttctgaagaacagcttttctacttgatgagccgcggtatttctgaagaagaagcaacagaaatgatcgttatgggcttcatcgagccattcacaaaagaacttccgatggaatacgcagttgaaatgaaccgtttgatcaagttcgaaatggaaggctccatcggttaatagtaaaaccccgccatatggcggggtttttttgtttattgaatagtgaaatttccgtattcgcttgaccggacatgaatcggcccgtttaaattgtagttcttctctttgacaatatcgcggaaaacgtcgacacgggcaaccgattctctccattcatcctgggtgtcctcatctgccggattcatcagatcgtcatagcgtacatccaagaatttattgagccatttcttctcgtccgttccgtctttcggtgacccgcccatttttttgttcgtgcgtttaatcagggcataaaaggagtctggatcatcaccgtcaccatgctgaatcaccgtatcgtacatcaccgctttggccaaggccgttttcagtccggcattttctgaacgtttcatcgccggctgataatacaagctgtcgtttaccttatcctgggcagcgcggaaggctttatcattgccaagtgagcgccaggcagaagcgaatcctttcagattgctgatgtcatcgctttcgtccttcgcaagacgacgcaattcaggcaaatactttttcaatttgttattcggcaccgctttcgtatatacttcgactacttccagcgcatctccggtagccgtcgtaaagccggcccgcccgcaagtgtaacctcttccgtcatccaacgcttcaacatatccgtattggatttccgtctttccgttttcaaaaatgctggtcagctgttccgcacggcgcttctgatccttattcagcccggccgcaaaaaccgtaccgctcatcatcagggtaaaaaacatggtgaaaataagagatgaaaccgccgtcttcttccaaaaacctgcttttttcttcaaattgattttcattgccatacccctttcatatgtaagttacgcactcagtatacatgagggggtgatttttttgttgaaaacacacgaatttgtcaatattttgaatcctaagccctatccagcgcttcataaaaagaacgcaccaccttcaccagacagacaatcccgttctcgcatcattcttatctgtaacatagtcaacgcggtgaaacccgcattgtacagcctgctgaaaaagggcttcgagcatgtccggatctttgcaatataacgttacatacgagcaatctgcgatgagaagcacaagttcacaggaactatccaaatattctcatacgtattgatttccgttaccatcccgctcgggaaagctttcaattcagcacacaacatttcaggcagaaaagagagggaacgggcgatcacggaaatggtgagggtgctgaagcctggcggcacattggccgtgtcagatataaaaaatacatcacaatacagagcaattcttgaggaaaacggctttcagacaagaacgtattccttttattatacgtttccgttttcgaaacttatcattgccgtcaggactccggtaggaaccgggcgctctatttgttaaaataaataagacaaaacagatagaaaaggtgttacacatgaagtcttatatgattatcggagccggcattctcggtgcgtccgcggcttatcatctcgcaaaggccggtgcggatgtaacggtctttgacaggaaacacccggggcaggcgactgacgccgctgcagggatcgtctgcccgtggctgtcgcagcgccgcaaccaggcatggtatgcgatcgcaaaaggcggagcccgctattataaccaattgatacagcagcttgaagctgacggagaaacggacaccggctatcaaaaggtcggtgccgtcagtctccatacggatgaaaaaaagctcagccaaatggaggaaagagcttataaaagaagagaggacgctcctgaaatcggtgacattacgagactgactccggcagaaacgaaggcgctgttccccgcgctgtcggaggaatacggggcggttcatgtcagcggcgcggcccgggtgaacgggagggcgcttcgtaaggcgctgttaaacgcggccgttaatcacggcgcggctgtttacaatgaagaagcgtcaatattgacagaggacggtgccgttatcggtgtgaaaaccgcagaacgcacgcttactgccggccaggttctcgtaacggccggcgcttgggcgagagagctgcttgaaccgctcggcatccgtttttcagtatcataccaaaaggcacagatcgttcatttagagcttcagggagaggatacgggcggctggcccgtcgtcatgcccccaaacgatcaatacattctcgcctttgacagcggcagaatcatagcgggcgcgactcatgaaaacgataccggcatggatttgcgggtgacggccggcggcctccgcgagatttttgacaaagcattaactgtggcgccggggctttcagacagtactgtgatagagacaagagtcggtttcaggccgtttactcccggttttcttcccgtcatcggcaaagtgccgaatatcagcggactcctcgttgccaacgggctgggcgcctcagggctgacgagcgggccgtatctgggggcggaactggcgaaactcgcactcggccagcagacggaaattgatttgagcctttatgatccggccggggcgcttgaataaaaaatagcttttggcgcattcttatgataggatggagctttaatgaataagaggacgtgacccattttgataaaaataaaccttcctgctcctgatgtaacgattacggaacggcagcagtcaccgtcggaaaatgaaccggcgattaaagcgatttacggtttcattgattttcaccgcattccgagagacaaaggcggcatctttatgttttataacattcatgatgaactgctgtttgtcgggaaagcccgtaaattaagacaaagaatcaaaaagcattttgaagacaatgtgtcgcctgttaaacatcacagggacgaagtgtataaaattgaagtatgtgtcgtcaatgatccgatggaaagggagatttacgaaacgtacgcgatcaatacccttcagtcgaaatacaacattgagaaagtattttataaataagaaaaaccggagcttaagggctccggttttctttatgtttacagtgccagccacatcactgcaatatgcacgatcagcagacagtaaacgacgaggaacagctgaacgaccttttttctgaataacatgcagatcatcatgagcacaggaaaaatcaggacgccggccgttttattgattgatgtattcggacggttcgacacgtcatagtgaatggccatatcagcaggaagaaacggataaaacacaatcgacagaataaaggcgagaaccacagctccccacagcaccttatcattcatcaaaaacatatgaacactcccttttttacctataatagtattttagtgtgaaaaagttcatttttcagtatttatttgatggctgtgtgctgtatgggtatttttaaacgcggcggccgccattgagacgatcgctcttgcggtagcggccatcattttgacagtagcaagcgttgacgaagattccgatttaggaaaagagcagctcatcgctaatgtcgttgaccgcattaacgcacagcactgaggatgaagaaagaaaacgctaaggagacgagccttagcgtttttttgattgaagcatctgttttaaatatgcttctgaatcaaagccgagttcctcgtcggcttcttttttcagttcaagctgaagtcgcacatacgtgtcatatttcgggctgagcttttgaagtagattgctgaaaggcgatccttccttcagcgcgggcagatcagaagcggattctccgatcttgatcaggctttctctgtactcttcatctgtctccactcttttcacaagctgaatgatgatgtttttatgagtgtcccaagtggcggggtctctctccaaaatccgctcgataaattggtcatgctggactttgtgctgttggagctgagccgggtcctccttaccgaccagctgcatcatcgggtgtgcagccggaacttcttccatatcatccaatactttaataagctttgcccatatcgtttttttctcatctgtatcaatagaaaagtcgaggaacggttcaaacagcgcggcgataaattctccgaaatctcccgggaacagttttttcagctgaagtcccatatacttcggttcatctattttgacctcgccgatatcatgcagaattgaatcgacattttccgcatcttccacgcgcttgatcagcatttcagtcagtttccgttcctgctcaagctcttcaatctgccggctgagcttttgatgctgctggcgcagtatatcatgcagactgctgccctctaagaggaacgctttaatatcgcttacagacagtgccagcattcggagggcggcaatcattttcagcgtattcacgttctgagcggaatactcacggtatccgttatcagggtttttgctgacggtgattaaaccttcctgctcataatatttgatggcttttttcgtgagacccgtctgcctggcggcttcttttatattcattctgaatcactccctgcttttcattctaaacgtgtctctaagggtcaggtcaagaaagggcgggaaattagacgggtttattctatattttagaaatttcagaaaatatgattgacaacgcacctttgttgcgattaatataacgttatataatgttatataacattatataataaaacactgaggagtgaaggatttgagtcaaactgccgcacaagtgaatcacaaggttcaggctttcttggatgatctgaaaggaaaaacgattgaccacgtctttttcgtcgcttgcgggggttcttcagccattatgtatccgagcaagtacgtgtttgacagagaggcgaaagccatcagctctgatctctacagttcaaatgaatttattcagcgcaatcccattcagctcggagagaactctctggtgattttatgttctcagtcaggcaatacgccggaaacggtgaaagccgccggtttcgccagaaaaaaaggcgcgcttacgattgcaatgacctttgagcctgattcgccgttagcgaaagaagccgaatatgtcgcggtgtatgactggggtgagaacgcacaggcgataaatacgaattacggggttctgtatcaaatcgtgttcggcgctttacacgtgctggaaaaccatcccgcgtttgagcaggcgatcgacggactcaataaactccagaccgtatatgacaaagcgcttaaacaagaagcggatcacgcaaaggcattcgcgaaagcccacgaaaaagaagatatcatttacacgatggcaagcggtgcgaactacggcgtcgcttactcctacagcatctgcattctcatggaaatgcaatggattcattctcacgccattcatgccggagaatattttcacggaccgttcgaaatcattgatgaatctgttccatttattatcctgctcggcttagacgaaacaagaccccttgaagagcgggcgctttccttctcaaaaagatacggcaaaaaactgactgtgcttgatgcggcagcatatgatttttccggaattgacgattctgtaaaaggctacctggctcctctcgtattaaaccgggtgctcagaagctatgcggatgcgctggcggaagcaaggaaccatccgttaagccagcggcgttacatgtggaaagtcgaatattaagaacgcgcattatatttcaccggactataatgatatataacgttatagtccggtgacaaaggaggaaaagcatctgaaaaagctcatctgcctgttcgttctgttagctgtatgtctgtcagccgccgcctgttcaagccaaagcagttcctctgacggaaaagtgaccctgaagttttttcacaggtggccgaaggagccggaaaaaagctattttgaagaagcggtcaaagattttgaagccgctcatccggatattcatatccaaacggaagcggtcttaaacgattcttataaagacaaggtgaaagtcatgctcggaacaacgagccccctgatattttcttttcatggagcgaccggtttgcttataaattcatcaaaggagataaagccctcgatctgtcgtcttactatcagcaggataaagattggtcctcacagcttgtgcagtcacaaatcaaaccctttacgcatgacggaaaacagtacggtgttccgtggcaaatggacgctaaatcattcttttataataaagacatttttaatacattacatttgaagcccccggcgacatgggatgaactgatcacagtctgtgagaaattgaaagagaacggatatattccgatcagtttcggcacaaaagcgccttggaccatttctcattatatcgggacgctgaaccagcgtatggtggatgaaaaaacgcgggcgaaggattacagcccggaaaccggggagtttacggacgaaggctatgtcaaagcgcttgaaaagcttcaggaacttctgccgtactttacaaagcacgtgaactccgttgatcacgaatacgtgcgccagcagtttacgagcggcaaagcggcgatgatttatgcggaaacggcagaaattaagctcgtcgaaccggtcaatctgggcttgtttcctttcccgaaaatcagcggcgaaaagggatctccccgtgcactgaccggatctcccgaaggatttatgatttcctcaaaaacgaagcacccgaaagaagccatggaatttcttcagtttttaacctcgaaaaaaatgggagagaagctgataaaagacgtcggtaaatacagcgcggttcagggaacggcgacagaaaacaattccaccccgatccagcgcgaagccgtgcaggatatcgtccgcgccgaaacaatggtgccgtggtttgatatggatgttgacgttgaaatcgccgatgtgtatgcggcaggcgttcagcagatgctcggcggcacaatgacaccgcgcgaggtgatgaattccgtgcagaaagcggcgcgtcaggtcaaagcgtcatctgaatagaacagatttctttggagaaaggagatgaggatttctttggtcagccgaaagcgtttcattccgtatctgtttctcgcgcccgcgctggtttttctgctgttcgtttacattccgattattgagaatgtgtttttcagtctgtttgaatggagctcatttcaacccgaaaagacgtttatcggtttgaaaaattatattgacctgttccacgatcccgtgttttttacagcactccgcaacaatgtgctgtatgcggtcatatcgctgatttgccaggttggcggcgggttaattctggcggccgtgctggaagacagattggtaagaaaatggtcgccgtttttccgtacggtattttttcttccggtcgtcatttccatgaccgtcattgcgctgttgtttgattttatttataacccggaaatcgggcttttgaatcagctgctggaagccgtcggacttgatgaactgacccgggcgtggctgggcgatgaaaacaccgctatgctgtctgtcatttttgtgtctcaatggcagtctgtcggttacatcgccatgctgtacattgtctcgattcagagcattcccgctgaattatatgaatcggcgcagctggacggagccggaaaaatccagcagttttttcacattacggtgccgcagacgaaagaaatgtcgtttgttgccgtggtgatgacgctgaccggcgcatttaccgtatttaatgaaccgtatattctgaccggcggagggccgggcaatgcttcagaagtgctgagcacatttttgtataagagcgcttttacaaaggatatgatgggctacgcttctgcgatcgcgacggtggtgcttttgctgacgcttgctctgtcgcttattcagatgaaattctttaagaccggaaaggaggagtaggccgatgcttcctgaaaagacggacttgcgtcatgcccgtcaggccgtcagaacaggcggaaaaccgagaaaatggtatgtcggggaaacgtctgtgtggctgtttctctttatctacctcattgccgttgcttatccgctgttatggatggcggtcagcgcctttaaaagctcggatgagatttttgagcacagctggtcgctgccctctgtctggcatcccgaaaacttcgtatccgcatggaaccaagggatttccgcttattttatgaacagcgtcattgtgaccgtgctgacttgtctcatcaccgtatttgtgagtgcctgggcggcatacgggctggcccgttttcaatttaaaggaaaagggtttgtgctgatcatttgtcttggcggcttgatgctgacgccgcaggtcagtcttgtgccgctgtactccattatccagtcattgggactgtacaatacgtattgggcattgattcttccgtacgcagcctatcgtattccgtttaccgtgattctgatccgttcctattttttgtcgatttccaaagagcttgaggaagcggcctatctggatggatgtacaagtttcggaatatttttcagaatattcttacctatgagcgtgccgattctggtgacatcaggcattttgacggcttaccatacatggaatgagtttatgtttgcgattatttttatcgatgatgaaaatttacggacgattccggccgggctgatgcagttcagagatgcgctgcagacggattggggcgtgctgctggccgggctgacgatttctgctgctcctattatcgcgctgtttttattaatgcagagatattttatccgcggcattgcagcgggaagcgtgaaaggataagggggatgaaaagatgaaactgatagcggccggagataatgtagtagattattatcaggatcaggagacgttttacccgggcggaaatgcgttaaatgtagccgtgcttgcccggcgcttaggccacgaaacttcttatatcgggattctcggcagtgatgaagcggcggatcacgtattgaatgtgctgaaactggagaaggtgaatgccgatctgatccgccgggcatacggagaaaacgggatggcggtcgtcacgcttgatgaaagaggggacaggatatttgccggatcaaataaaggcggcgtgcaatcgcgtctgacgctcgcttttcaggagaatgacatctcatttatcgccggacatgatctgctgcatacgagcgtatacagcaggatagaacgtgaccttccgatgctgagcggccatgtgccgatttcctttgatttctctgtaaaacgtgacgaagcctatttagaagcggtctgtccgtatgtgacgtatgcgtttttttccgggagtgatttgagtgaaagtgaatgtgtgcggcttgccgaaaaagcccgcggtttcggagcgaaaatcgtttgtctgacaaggggagaacatggcgcggtgttatcggatggggaacgcgtctatcatcagccggtggtaagagctgatataatagatacattgggggcgggtgattcttttatcgccgggtttcttaccgatttcttcgaacatcaggatattcggcgagcgcttactgcggccgccgggacggctgccaaaacatgcgggggttcggagcgttcggttacgggcatccctacaggccggacggcgggaaaagcagtgaaaaaacgagaatacgataagcattgtctcgttttttatacttgttacgcataggggctgttaatggtaaacgtgacgcggtcggtatgcattaaaaacagcgaactgtatatcggctgttcttttgacataaaagcggttttgtcaatttcaaaaagcgcatccccgatatcacaagccagatagcggctttcttcctgcttggcgtatacgacatttaacagtttcgtattatgggtgggcaccacctgatagtgctgtttcaaaatgtcatgcatcgacacgccgcctttaatatgcttgccgatgtcgggaaataaactgagcggatagtgggcgatttcgaatgagagcggctggtcgtcgtgaaataaaatgcgttttaattcaagaacgggactttcggaagcgacgcgaagtttttgagcgatggatttaggcgcttcaatgatttcatgggaaaggatctggtgtttcggtttttttcccgttgattccataaattcagagtagccgttgaccgcgatgagctcccgcttcagtttagggcttttaacgaacgttccctttccctgctgccggacgagccagccttcttccacaagatcaaggatggccttcctgactgttatgcggctgacgttgtacgtttcgcacagctcattttcagtcggcagttttacggacggcgaataaacgcccttcttgatatcgtccgcgataatttgtttcagctgaatatataaaggtttcgagctcccgttatttaacaatgggacggacctcctttgtcaagtagtagtactattatatgtattatgatgttataatacaaatttgcctttcatttatgaatctgtcagaaaccccgaacatttttaacataacagaaagatgtggcggtttccagtattggaggaggtttcgaatggcatcattaacatttgaccatatcaaaaaaacatacggcgcccaatcggcggcagtgaaggattttcacttagatgtaaaggatgaggagctgctggtgcttgtcggtccctccggctgcggcaaatctacgacactcagaatgattgccggactggagagcatttctgaagggaagctttatatcgatggagacgcggtgaacgatctgcccccgaaggatcgtgatatcgcaatggtttttcagaattacgcgctgtatccccacatgacggtgtttgataatatggcgttcggtttgaagctcagaaagctgccgaaaaaagaaatcgcagagcgagtccggacggccgctgatattttggaaatcgggcatctgctcaagcggaaaccgaaggctctttcaggcggacagcggcagcgggttgcgctcggccggtcgatcgtgcgggagccgaaagtgtttctgatggacgagccgctttccaacttagatgcgaaactgcgtgtgacgatgcgcgccgaaatcagcaagctccatcagcgtttgaaagcgaccatcgtttatgtgacgcatgatcagacggaagcgatgacaatgggtgaccggattgtcgtcatgaatgaaggaaatattcagcaggccgcaagcccccatgagatttatcattatccggcgaatatgtttgtggcgggttttatcggttctccgagtatgaattttataaaaggcgtcatagaagaaagtcacgggcaatggtattttgccggttcgtccgttcgtctgcccattccgaaagaaaaagcggccgttcttgtgcagaaaggatacagcggtcaggagatgactgcggggctgcgtccggagcatttgacgcttgccggacaatcagagcacccgcctgaagcggtgtgccgcgctgtggcggaagtatgtgagaacttaggcgcggagatgtacgttcatgcggtgagcggagatgaccgcatgacgatccgccttgacggcgcttcagaggtgaaacccggcgatgccattctgcttgcggtcaatatgaaccgggccgtgttttttgatgccgacactgaaaacgccgtatattgaaaaagggagcctgatgatggggctcccttatcacttcttatgatacgattaccagatttcgtccgcccattccgggtggtcgataaacggattgcggttatgctgatagtcttcgtaaatgatttcgttccgccgtttttccttactgtcgacggggtcttgtttattccatttgagcaaaacggacagttttcccatgtaaggagctgagccgtttccggttttatcattcagctcaaggtcgggatacccgtcgccgccttcataacgcaccgccatgtaaaacagcatgcgggcgacgtctcctttgacctcatcgcgcggctcccaggaatcaccgtcataataattgcccggcgctttcgggtattctgagccgccgttatcaaaatccatgtttcctctggcgctgttcacctggacgtctgcagggcgcagatgatgaatgtccgtcccggggccggcagctgttccgaagtttccgtgtgactttgcccacacgtgttcacggttccagtccccgacgctgccgccgtttttacttttggcccgtgattcctgggtgtagagcaagatgacattgttcgggtttgccggatcttcgtcagtttccttcaatgcattccatacttggctgtaagacagctttgtatgtccgctgatgatgcggtgcagggcgctctttaaggctgttccgctttttccggaagcttctttgtaatatgtctccgtatccgcagacggagtgatgacagctgaggaagtttgcggaaaaagagttgtgccgccggcagttgaaaccgccagccggctgtacagattcgtgtcagccggcgcgcccgcagaggctgacggcgcggtccaacccaaaatgaaaaacaggcagacaatcggcagaaaccaaagtttttttgtcatgacttgccctcctttacctctattatccaaaaaataaatctaatattctatcttttttgaaaaatggttccttcggcttatgggacagaggggcggtttcttggtcaaagtatccggaaaatcattgattttttggaagatatgataatgaactcgttatgcgctccttctataatgaagatcatcttgtcagtttttcagtttaaaaggagggcatatatggaacatcagcagctttcggcggcgaatatcgggatttccgatgacatacaatggctgtctcaattcggcgcttccgcttccggcggagtgacgaggcttttatatacgaaagaatggatggacgcccagcttgccgtcaaaaagaaaatggaggcgttcgggctggaaacggcatttgacgatgtcggtaacgtgttcggccgtctgagcggcacagaatcgcctgatgaggtgattctgaccgggtcgcatattgacaccgttattgacggcggcaaatatgacggtgcgttcggcgtgctggcgggcatgctggcgatccggcatttgcatgagacgtgcgggcgtccgaaaaaaacgctggaggctgtgtcgctctgtgaagaggaagggagccgttttcccatcacctattggggctcaggcaatatcaccggtgctttctcgctttcagatgcggaaacgccgaaagacgcgtccggcatttctctgaaagaagccatgcggcagaacggcttcggtgcaggccgttatccggcgccgctgcgcactgatattagtgcctttctggaaattcatatagaacaggggcaaacgcttgaacgatcgggaaaggatatcgggattgtcaccgggattgccggacagagacgctataccgttacgcttgacggtgaatgcaaccatgcggggaccacttcaatgaaatggcggaaagatccgctcgcggcgggaagcagcatcatccatgaactcatgctctcagcggaaagacagccggaagagctccgcctgacgtgcgggaaaatgacggttgagccgaatatggcgaatgtcattccgggccgtatccagttttccgttgatattcgccaccagcaggaagacgtgctggcagccttccatcagaaactggtgtcgattattgaaaacatcagccgcagcaaaggagtcagaccctttattgatgaatatatgaggatagagccggttcaaatggatcacatactgacacgaaccgcagcacaggctgcaaaagagcagggggcggacccggagaagatcgtaagcggagcgggacatgacgcccagatgctcggcagaacctttccggcctgcatgctttttgtgccgagccgtggcgggatcagccactcgccgcttgaattcacacccgcacatcagcttgaaaccggcgtccttacgctggcgaatgtattacataaacttgcttattaacgtaaagggggaatcggcgtgccgaccagaaaagaattgtgcattccgcaaagaacgataatgacaccgggaccgacagaagctgaaccgagagtgctgagggcgatgggcgctccgatcctcggccagtttgacccggcatttaccggtatcatgaacgaaacgatgcaaatgctccgtgaattgtttcaaacggaaaaccgctgggcctatccgattgacggcacatcaagagcggggattgaggctgttctcgcaagtgtgatagaacctggcgacagcgtgctcgttccgatatacggacgcttcggacacctgctgactgaaatcgccgagcggtacggagcggacgttcatacgatcgagtgtgaatggggaacggtcttccggcctgaagagattatcggcgagatgaaaaagatttccccgaaaatcgtcgctatggtgcacggagaaacatcaacggggcggattcatccgctgaaagaaatcggggaagcgtgccgcgcccaagatgcactctttatcgtggatgccgtggccacgattggcggatgcgccgtaaaaacggatgaatggaagattgacgcagtcatcgggggaacgcaaaaatgcctatcggtcccttccggaatggcgccgattacttataatgaccggacggccgctgtcattgccgcgcgtaaaaaggtagaacggggcattgcgacagcagctgacggtaaaatgctgtccggtcatcggccggttacgagcaactattttgatctgagccagctcgaagattattggagtgaaagaaggctgaatcaccatacagaagcgacagcaatgctttatgcgctgcgggagggtgtgcgccttgttctggaagaaggacttgaagaacggttccgcaggcatcagcgccatgaaaaagcgcttacggcgggacttgcagcaatgggccttgatttattcggcgatccggaggcgaagctgcctgtcgtcacatgtgtgaagattccgccggaagcagacggcgaatcgataaggagtatgcttttgtctcaattcggaattgaaatcgccagttcgttcggtccgctgcaggggaaaatttggagaatcggaacgatgggctacagctgcagaaaggaaaatgtgctgtttgtgctggccggacttgaagcggttctgatcagacacggagttgcagttaaagccggggaagcgctgcaggcggcccttaacatatatgatctgccggctgaaaccggtatgctgtcatgagatatgaaaacgagattgaaatcatctggacttttttcccttttccccgttatactgaatggtataaaaaatgacaaatatggaatgatcatctgtttgtctggggagaaggtaagaaatcatggcgtacatggggcgattgtcaattttaatgctgaatatgtttattgcgatgcttgggatcggattgattattccgattatgcccgcatatattaccgaattcggagcgacggggagcacgatgggtctgcttgttgcggcggcggggcttacacagcttttatttgcgcctattgccggggaaataaccgacaaatacggacggcggaaactgattattttcggcattgccgcctttgccgtgtcacaattgatcttcgcctttgccggaagcctgtggcaattgttcgcatcccgccttttgggcggaatgggcgcggcgtttttaatgccgtcaatgttcgcttacattgcggatattacgaccgaggaagaacgcgggaaaggaatggggctgttcagcgcggcgatgacgctcggtgtcgtcatcgggcccggtgtcggcggttatttggttcattacggcatgtctgtgccgttcatcgtgtccgcaagtctcgcctgcttttcaacggtgctttcatttttctttctgcccgaaacgctggggcgtgaaaagcagctggaagcccgggcaaaaacggaaaaacgtgagcatctgtttaagcaaatgtcacgcgcgctcaaatcgccgttcgcgtttatgctgattctggtttttgtgctgaacttcggaattatgaactttgaatccgttttcggcctttacgttgaccataaacacggatttaaagcctctgatattgcctttattattacggctgcgggtctcatcggcgtatttgtgcaggcggtcggcgtcagttatctcgtccgcaggttcggggaaaagcgcgtcattaacgtgacgttgatcggggctgctgcaggacttgtgtggtgccggtttgcgggttcatattgggccgtttttgccgcggcaatctttttcctgacgctgacatcgctgctccggccggccgttaatacgatgctgtcgaagctcgccggtgaccagcaggggtttgccggcgggatgaacacctcattcatcagcttagcgaatatcgccgggccgtcggccgccggttttctctttgatgtaaatatggaatttccgtatatgctgggagcggccattctcgccatcagttttctggccgcgcttggctggggcaaaaagacacagacccggccgttcacgcagcaaggataagaatcaaaagcctccgggtatccggaggctttttgctgattgtcgtttattctgcggctgtctgcatctctgaaattgcagagatgcgcatagagggaaaatcatatagcaaaaacagttgttccgtatgctcaagcatggcgcgaatggaaaccggaacaggtgtagataaagtaaaaccagctttatcgcttgacgagtctgatgaatttgatctgccggaagttgatcaaaaaagaaggcagtcaggcaggcagggacaacattgagcggcgtaaatgctgagaaggaaaaagcagggttttggaacttgctgtttcgtatgcagggggagagcattctgataaaacgggtcattgaaataatacgaactgttcagtagggggcgattggtgacaacaaggagaggttatcttataaaacctctcccggaagatgttgtgatggttctcctgcatgaattttgcagattaaaacccgcaattaggccaacacacaattatgcaagagacaatcatctaaaaaggatgtcggtaagtacaatatggtgtacggaaaaggagttgaaaatgttgtattattacccgtcattccatttgtatcagcggcaagaatttaattattatccatgggcccatcaattgactcattcagggggctccccctatgtttccgcgcgccctcctttttataattccccatgttacagagagtgcataagaagcggagcggatagttatttctgctgctatatctgcggtttctgttaaaaagaaagacttatagaagtaagtgatctttccaggatgacagtgagaccattatccagacagccattagccaacacacgaagctttattacggttcacggaggggaagcgcccctcctttttcagaaattttataaaatccccttgcgcggcctgtcagaagcggtttttggtcttgatgtgttcgactgttggtgttgacgaagaattcaagataccaggaagcagcgaaacctgtatgtatccgcgagacacaaagctttccgccgctgagcgggttcattgtcactgcgttctgtctcctgtagtagataacgagattttggggctgtcagttgaggaaaaataaaaaattcaaaacgtcgcaatcgtttaattaaaaagaagagatagaatctatctcttcggattattactgaactacaaaatggtatcgggttttccaagtggaggaatcatcatagaattcaatccaggcttctcctttagcgactgcaaatacctgaatggttttgtagtcagtacctaaagctctccatgtcacagcaggagggttataacccgtaggattaaaggaaatgcgattaccagaagtagaataattccttatctctcctacttttaaattgacgcgggtttcagactgagattgaaacaaattcttattcactttagtagagggaccggcggctgatgctgaagagttaaaaaaaggcgcgaaaacgaatgaaacaattgcaagtgataacaaagcatttttagctagtttcaacgtaaaacctccttttggtatttataggataacagtaacacttaatggaaatataacaatgaagaaattgttaaatattctttgaaatgagtgaacacatgccaagtgaattgataaatgcaaacatcatacatgtttcttacgtagataaggctgctaatcaaaagcggtttttttatgaaatcagaaaaggaaaagcagcatgactttcagggcggcgtggggaagtggttgagtcttgtgtcgctccccgctgattttcaaatgaatggcgaaaccatcaaaaaagggtcatgggtgcttgtgacaaaggttccgaggcagtttaggatgaaatcaaaaagggtgagattatcggttgcatcctgaatatcgaaaaagcctgatgatatcaatggcagcattttttgagggtttagctgaatgaatccccttaaataggatgcgggagaacacccgcatcctggtctatggctaaattttaaccgatcagccgctgcattctcagcgcgagccgcaggcgcatcgtcgtctccggatcttttaagcttttgccgagcagttcctcgcatttttctaaacgatagatcaccgtatttcgatggacgtacaggcgcttagccgtttctgaaatctggcagtgggtttccaggtaaacagacagtgtatgaagcaggctctggtcctccttttgccggtcggccaggctttggagggtggcttcgtaaaactttttcacatcttccgccggaagcaggccgagcaactccggcacgtctttggcatgatagatttgaataaactccgcgcttctggacaaatgcccggatgaaatggcgtctgaagcttcagtaaaagcgtcagggacatcgatcagcttttggcatatgtttgagatgccgaaggagacagtccgtttaaactgcgtccggacctgtttctgaaactgctccaaaaagctgatgacagacgcgtgcatttcattccagctgtctgtcgcttcaattaaaagaataccgacatttcctttaataaagagatgagggggaaacggaaaggatgacagctccccttcaagcagatcaaatacatgatcggaaacgagctgattttcggtaaagctgatcgttttctcatttcggtcgagttttccgcaaatgcacatgtatttctgatcccagcggagccggaattctttggcacggcttttgatttcttcatggccggtaaacgagcggtcgatgaaattgctgaaaaattcattgcgcgcccgtctgccgaattgtttgacggcattttctttcagcagttcaaaggaaatgacgttggccgcctgttcaattgtcaaaatcatgcctttatcagcggtctgcaccagctccggaatcaccagataaccgcagtttttttcaacattcagaatcggcaggacagaatacacctttctgtcggagagcatggaaaagcaggtgaaataaggaccggaaagggaataacagatgtttttcaataaagacgtgtcaatgggtatgctgtgggacgatgataagagttttgtatgctgatccaaaagcagcacgggaagccggagaatgtctgagagcttcttaagcagggattgcagccctttgccgctcatgatgtggtttgtaaattttttatgggcgtaaatggcctgctgcagctcatttgaacgcatatcaagaatatggctcaatgtagcattgacgatatctcccagcctgatgtcttccggcagctcaataatcggaaattcataccggtcggcaagctctgcggcatctttcggaatgacattaagatagcgcttcgttttgatccccagtcccgcgcatccccgttttgccatgaggcggattaaatctttcaacagctgcgggcggtccttcaagtggtaagccgtcgtgacgagcaattcgtttttatgtaaaaaatcagcgatgtccggcgcatccatcatgttgacgtgctgcacctccctccagccgccggatctgcctgcgattaatgcggcccgctcataagcgggaatcttcatcacatcataaatattcatcagtcaatctcctttcaggttctaaagacaaccattggttaatatgaataaaagtcatcaaaaattatagcggttttgctgatgtattacgatcatagtagcagtaaactggcaatcatagacgcatgttgtgataaaaactgacagaaaatcgtcatccttacagggaggaagataaaatggcctatgacgtaattgtaaagggtgcgaaagctgtgcgaaaaggcgggacagagcgggccgatatcgccgtcaaggacgggaaaattgcattgatcgagcccggcattgacgaaaacgcggaacaagtggtgcaggcagacggcatgtatgtgtttccgggcgcggtcgattgtcacgtgcatttcaatgaacccggacgcgaagaatgggaaggcattgaaaccggctcaaacatgcttgctgccggcggctgtacggcttattttgacatgccgcttaactgcattccttcgacggtaactgctgaaaacctgctggcaaaggcggaaatcgccgaacggaagtcagcggttgattttgcgctttggggcggtttgatgcccgggtataccgaacatatccggccgatggcagaagcgggggcaatcgggtttaaagcgtttctgtctaaatcgggaacggatgaatttcaatcagccgatgaacggactcttttaaagggaatgaaggaaatcgcggcgtgcggcaggattttggccctgcacgcagaaagcgacgccctcacccgattccttgaagccgagtacgcgctccaagggaaaattgatgcccgcgcttacgcttcctcccgtccggaagaagccgaatgcgaggctgtgcagcgggcgattgaatatgcaagagcgacgggatgcgcgcttcattttgtacatatcagcacgaaacgggccgtgctctccattcagcaggcgaaaaaagacggattggatgtcaccgttgaaacgtgtccgcactacttattattcagctttgaagacttcctcaaaaaaggggcggctgccaaatgcgctccgccgctccgctcagaggctgataaagaggaattgatcggggttttggctgaagacctgattgatatggtgtcttcggatcattctccctgtcatccggctttgaaacgcgaggataatatgttcctgtcgtggggcgggatcagcggaggccaatttacgcttctcggcatgattcaattagcgatcgatcatgggattccgtttgaacatgtggcccgatggacggccgaagcacctgccaagcgtttcggtttaacgaataaaggccggcttgaagaaggatttgacgctgattttgccattgtccggccggaaccttttaccgtcacaaaagaaacgatgttttccaaacataagcaaagcctgtatgaaggccgcacctttccataccgaattgctgcgacctacagcaaggggtgctgtgtgtatcaggatggcggtcgtaagcagagcgggtctttcggaacattcctgaagccttgtgaaataaaaaagccgattctctgatgagaatcggctttttttgtcgtttggaaagcgggtctcgtggtatctttttataaaaaggagtaaaacacattgtatgatcaaatcttgaacatattaacggcatcctggtcgcgcaagaccagtacaaaatggacggaagattgcccggccacaggccagtgcggcgtgacggctttagtcatccaagatgtttacggcggtgacattctcaaaacaaaaaccggcacaagctggcatttttataatcgaatagacggggagatatatgatttcacgagcggtcagttttcagagccgatcgtctatcagcatattctttcttccagagatgaggcattttcggacaccaatgaacatcagtaccgttacctgcaaagtgcattcagaaaaaacatggaaacggaaagagaaaaacacctgtgataaactagaatgagaggtgaaggattgtgatttatatcggactgacggggtggggggatcatgacagcatctatccgcctaaaacagcgggcccgcaaaaactgcaggcgtattcctcccattttcccatcgttgagctggacgcgagcttttacgcgatacagcccgcccgcaataacgaaagatgggtcaaagagacgccggaatcttttcaatttgtcattaaggcatttcaaggaatgacgggccatcagcgcggtgatattccctttgaatcgaaggaagaaatgtttgaggcgtttaagctgtcattatcgccgtatatagagcatggaaagcttgccatggtgctgttccaattcccgccgtggtttgactgcaagaaagaaaacgtcgcatatttaagatggtgcaggaagcagatgggcgatatcccgtgcgcgcttgaattccgcaaccgatcttggttttccccgccattttacgaacagacgctttcctttatgaaggaggaaggctggattcacagcatatgtgacgagccgcaaatcggcgagggcagcattccgaccgtcctgaaagcaacggatgaagaaaaaacgcttgtccgttttcatggacggaacaagcagggctggatcaaacctgacggcggacaaaactggcgtgaggtcagatatttataccgctataacaaacaggagctcaaagattggaaaaacaatcttcaggagctgaaaaagcagtcgcgcaatctgtatgtgctcttcaacaataactcaggcggagacgccgccgataacgggcttgagatgcttgaaatgttagatatctcatataccgggcttgctccgaagcagctcgacctattcagctagaaaagaggtttcaagacacatgtcttatcttattttgattatattgggatttatcgcgggaacggtcggcagcctgatcgggcttgggggaggaattatcatcgtgccggcgatgctctatttaagcacgatgaccccgtttttccatgacgtaacaccgcagactgccatcggcacgtcccttttggtgattatttttacgggcctgtcatcaactctggcctatatgaaatataaaaccgttgactacaaaagcggactgatcttttttatcggttccggcccgggaagcatcatcggcgcgtatttgtctaaactttttaatgcgcatacgttttccgtctggttcggactttttatgattttgatttctattacattaatgctgaaggcgaaagcaaaaccggtcaataaagcgcataaaggcatgatccggacatatgaggatgaaacgggtgagctttatacatattcgtaccgtatttttaccggtatcgccattgcctttttcgtcggtttattgggcggtcttttcggcatcggcggcggctctcttatggttccggccatgatgctgttatttttgttcccgccgaaagtggctgtggcgacgtcaatgctcatcattttcttatcctccgtgacgggttccgtgtcacatatcgcagagggccatgtcaattggctgtatgcgctgtgcctcgttccgggcgcgtggttcggcgggaaaatgggcgcgtgggtcaataagcgggtgcagacgaaaacgatcgtgcttttcatgcgggtcgtcttgattttgatcggctgtgaattgatttatcaagggatattcagctaaaaggtaggagagatggtatgttagagaaactccgtttatatcatacgaatgatttgcacagccatttcgaaaattggccgaaaatcgtacattatattgagcagaagagaaaagagcatgaaaaaaacggggaggaaacactcgtattcgacatcggcgatcatatggaccgatttcaaatgataacggaagcgaccttcggcaaagcgaatgtcgacttgttaaaccggcttgagatcaatgcggctgccgtcgggaataatgaaggaattacgctgcctcacgatgagctggcgggtttatatactcatgccgcgtttcccgtcattgtgtccaacctgtttgacgcggacggacagcggccggaatgggccgagccctacgtgatcaaaacgctgaaaaacgggatgaccgccggcatactcggggtcacggtgccgtattatcccgtctatcagaaactcggctggacggtgacggatgcggaaaaaagcattcaagaatcacttgacgatatcaagggcaaagcggacatcatcattctgctttctcatttaggcctgatcgatgaccgggccgcagcggaaaaatttcccgacatcgatgtcattcttgaatcacatacgcaccaccttcttgaggacggacaggatataaacggcgtattgcttgcatgtgcggagaaatacgggaactatgtcggctgtgtcgagctgacgatagaaagtgaatcacgaaccattgtcagcaaacaggcatctgtacagaaaatggctgattggcacggggaatctgaagatacggcggcttttctgaaagagaaagaacgggaagcggaaaacctgctctccgtacaagtcgccaatctgaatgaagaagccggcgtgaagtggtttgaggaatcgccgctcccgcttctattagccgaagcgctgaaaagctggtgcggctgtgaagtcagcatggtgaattcaggcgtcattttggggcctttacagaaggggcctgtcacaaaacttgacttgcaccgcatctgccctcatccgatcaatccggtcgccgttcgtctttcaggcagggaactccgggaaacaatcagccaggccgcctcggaacaaatggagcagctgcggattaaaggcctcggcttccgcggggaagtgatgggcaggatggtatatgccggagcggaggcagaggccggcatccttgaagacggtgtgacgcatctcctcaatgtgaaagtgaacggagaagaggtggatccggagcggatatactcggttgccgttctcgacatgtttacactcggaaagctgttcccttacatccgcgattcaaaagaaaaacaatattttatgccggagtttttaagggatctgctcgcctggaagctcgcgcggcaagcgtaatgtcaaatatccgccggccgttccatctcacccgaatgaaggtaagcgggactttttaagagcaaaaataaaatactatgtcccctcttacaagcatacattgtgatatgtaaggggggatttttcttgcctagataccggagcgctcttcgcaagagagggcctttgccttttcgatatgtgcttcttctgtcgtttgctttttttatcatatcgacggtcatcagcctctggatgatcaactcctcaatcaaaccggtgctgatgaacataggagaaatggaaaccaaacgggtggcgacagaggtcattacggaatccattgaagaatacatgtctcacagcgacaatgtgaaagatatggtcgatatgaaaacggatgaaaacggaaaagtcacaacgatggattttaatacacaaatggtcaacagcatgaaggcgaaagtgacaaagcagcttcaggctcatttgaaggaagcggagtcgaacaataagcagcatgaaacggaaaaaggcgcgaaaacggccgatgaaattatgattaacatccctttagggcaggtcacgggaaacagcgttctcggaaatctggggccgaaaatccccgtgcgctttaacctgatcggtgatgcgttaactgatgtgaaaacaaaaataaagccgtacggcattaacaatgccctgatcgatatcagtatttttgtggaaattaaagtgaaggtcattattccgtttgccagtaagacatcagtcgtcacaaataatattccggtctccattaaagcgattcaaggagaggtgccgcagttttataacggaagcggcggatcaggtgtgacgccttctgtccagctgccgagtgaaaaacagaagaaagataaataaaaacacacagccgcaatctttcctggcggctgtgtgtttactttttcctgcggatttcttttcgctcccatgcccttaaatggggatacgggtcaaaagaccattccgatctgccgttatctttatacatcccgtagtgaagatgcggcggaaattttcccgcggtgcccggcggtccgtatccggaactgccgacagagccgatcacctctccgggtttgacgatctggcctttatgcacaccttttgcaaagccgttcaggtgagcgaagtagtgatacgtgttattgatatccctgatgccgattctccagccgccgaaacggttccagcccttcatttcaacaataccgtagcaggtcgatctgacggggagtccgtaatgagcgaacagatccgttccttcgtgaatccggcgcccgccgaaaccccgtgcggcgccccatgtgctgcggtagctgtaatccgtcttcacgggaagcggaaaagcgtgctctccgagatcaaggcggccgaacgttttaaacagtgtcatgaattcggtgataatgccgaccgtctgatcacggcggtaataattccagaggccgatgcggatatggtcaagatccgttccgaatcccgctaaatactgtgcaaatgtataaaggatatcctcatcattgctgacctcggcttttccgtcgccgtcgccgtccaggccgatcccgtcaaatactttaatgctgaggggcgcctcgtccttaggatttggattttcaggcccgctccacaaatgatccggaatataaatgctgatgattcccgctttttccggcagatcctttcggttcgagcggacattttcttcatattgatcaaccgccgcaagcacataccaaggaatctgcgtgactgcttcggctttgcggtacaactgcatccgttcaccgtaaacaggagccgattgttctttcccgcttgcagccggacagaaaactgataaaaggagaagagcagataacagaactttcacaacatgatctcctttcaggattaatacaactagtttgcggcaacaatccgagaaaatgtaagtaattctcttcccttgtcgagaaatttttcctatgttaaagtgactattgaatagaaatctgcaagttttatatccatcgtgaaatagaaatttttcgcacacgaacatgaataaagggataatggagatgatggggaaatggcaaagaaagacgagcatctgagaaagccggaatggctcaaaataaagctgaacacgaatgaaaactatacgggtctgaaaaaattaatgcgtgaaaataatctgcataccgtatgtgaagaagcaaaatgcccgaacatccatgaatgctgggctgtcagacgtacggcgacgttcatgattctcggttccgtctgtacgagagcatgccgcttctgcgctgtcaaaacgggtctgccgactgagctggatctgcaggaaccggaacgcgtagctgattcggttgcactgatgaacttaaagcacgccgtcatcacggccgtggcgcgtgatgatcagaaagacggcggagcaggcgtctttgcggaaacggtccgggcgatccgcagaaaaagcccgttcacgacaattgaagtgctgccatccgatatgggcggaaattacgacaacctgaaaacattaatggatacccgtcctgatattctgaaccacaacattgaaaccgtccgccgcctgacaccgagagtccgggcccgcgcaacatatgaccgttctttggaattcttgcgccgtgcgaaagaaatgcagcctgacatcccgacgaaatcaagcattatgatcggtctcggcgaaacgaaggaagaaattattgaagtgatggacgacctgcttgcgaacaatgtcgacatcatggcgatcggccaatacctgcagccgtcgaaaaaacatttaaaagtccaaaaatattatcatccggacgaatttgccgaactgaaagaaatcgcgatgcaaaaaggcttcagccactgtgaagcaggcccgcttgtccgttcttcctatcatgcggatgaacaagtgaacgaagcgtctaaaaaacgccaggcccaagcataagataagccgaaaaaacccaaaacgccgcaggttttgggttttttgtgatggagccgtctgtgcagggaaaaagtcattcttgaataaggatcgtcagaaccgctacactggatataaaaggggaaaatttttccgtccgtccgaaccgtctcattttgcaattgatggacagaagtcaatgaattatgatagtaaagagtgataaaagaggtgaagacatgattcttattcaaaatgccgagtttgaactcgtacacgattttaaaaacggctttaatgaagaagcgttcaaagcccgctattcggacatattaaataaatatgattacattgtgggagactggggatacagtcagctgcggctcaaaggcttctttgatgaccagaatcaaaaagcaacctttgaaacgaaaatcagcacattggacgaatacatttacgaatactgcaatttcggctgcgcgtattttgttttaaaacgaatcagaaaataattgatgcagaaggggatgctgtcacgtgtattttgttgacagaaataatatcgaacaaacactccgtttttttgagacccagctggcgctgtttgacagcacgcctgcatggcagagcgaaatcgaaaaaagggcgcttgagcggatcagccatcttatgatcgaatgcattctcgatgtcggaaatgatatgattgacggctttatcatgcgcgatccggggagttatgacgacatcatggatattctgacggatgaaaaggtggtagctgaggatgaagcgaataagctcaagcagctgatctcttccagaaagcggcttgttcaggaatatcagcaagccgatcatcaggagctgtttacgctgatcacgtcaaacagggacgtgctgaaagcctttccggcccgtgtaagaacctacctggaaacagaattagggcctgtttccgcatttaaataacaacgagtgagaaaatccacaggagtgttgagtatgaaggattataaaggatatttgatagatttggacggcacaatgtacaacgggacggaaaaaatcgaagaagcgtgtgaattcgtgagaacgcttaaagcgcgcggcattccgtatttattcgtgacgaacaattcttcccggacgccgaagcaggtggcggacaagctgatgagctttgacattccggcaactgaagagcaggtcttcacgacgagcatggcgactgcgcagcatatcgcccagcagaaaaaagacgcgtcggtgtatgtgatcggcgaagaaggcatccgccaggccattgaagaaaacgggctgagcttcggagaagaaaacgcggactttgtcgttgtgggaatcgaccgcggcattacatatgaaaagttggcaacgggatgccttgcgatcagaaacggcgcccggttcatttcaacaaacggcgacgtcgccattccgactgaaagagggcttttaccagggaacggttcgctcacatccgttttgacggtgtcaacgggcgttgagcctgtctttatcggcaagcctgaatccattattatggaacaggcgatgcgtgtgctcggaacggatatttccgaaacactcatggtcggcgataactatgcaacggatattatggccggcctcaatgcgggcatggatacgctgctggttcataccggagtgacaaagcgtgagcatatggcagattacgaccggaagccgacatatgcgattgactctttaaccgaatggattgaacatctataaaaaagggacggccatgacggccgtccttattctgtatttctggcgctgtgggcaagccggcttgaagccgctgctgcgattgcgccgacgatatcatcaagaaacgtatggcattcccccgtagatttatcatttaaccgcccgagaatgccgggtttttctttgtcaatgtagccgtaattcgtaaagccgattgagccgtatatattcacgatagagaaggcgagcacctcgtcaaccccatacaggctttcatcaatcgccagaatggtctgaagcggttcagacagttttttttgttcggcgagcacatctaattctattcccgttaaaatggcgttttgcacctcgcgttttgcgatgacacggtccacattgagcctgcatacttccatcgtcaaatcaggatgatattttttctgaaggaaatacaccagctcggcaatatcgtccgtctcaaccccccgttcttttaaacgcgctctggcgacagcttccacctgattcagttgttccttttctgacatttgcttcacccaatctttttttactagtttatacaacacccttccgatgtgtacgatgtttctccacttgattcaaaggattacaatatgtattcataattccgccggcgtatgactacgatgtgaatagctctaatttttcaggcaggtgattatgatgaaaagcatcattaaagaaaagtacggcatccacgtcagacagctttccgtttatcagaaataccaatgcttccagacgcctaattccttctttcttattattcccgtttccgggttttcgcaatcagagctgacggagctttactacatgagtcagtatttacaagaacaaagtgacccatacgtttcagtgtttatctttacgaaggaaggagaactgacctttgaggacgaaggcaaaacgtatgcgctcttaaaagcgccgatccccgtcgcaaaccggtcgttctctgtcggaggggagcttgccgaatttcacagaaaagggcggggttttccgtacgaagtgaaagaagcgggcaggatcggccaatggaaggacttatggggaaaacgggtggatcagctggaatcattctggatgcagaaaattcatatgtctccgcttgaaccgttcgaaaagaaaatgatcgaagcatttccttattattcaggcttagcggaaaatgcgattcaatatttagtggatacggagctggatgacaatcccggcgcagaagactcggggacaatctgccatcagcggatggaacgggatacctggtcggaggaatcattgatccgcattccgggcgattgggtattcgaccatgccgcccgtgatattgcggaatatatgcgcagcacatatttgtatcatcgtgacgacttgcttaacgaagggtttttgtttttgcaggaatatgagcaagttacgccgttatcctccttttccaagcgcctgttttacagccgcctgctgtttccgcttcatttctttgagacggtggagagttattacatttctcatgattctgaaaaacagttttacgaagagcagcttgactacattcttgccgactgcacccgctatgaacagtttttacagacatgtcacgacatgatgaatgtcaggtcggcgcaggtttttgtcccgcctgtggcgtggctcggaaaaggaatcagttcgtaagaaaatataacgtaaaaatatttagaaaatagggaatcttgtcatatcaatgtgttaagcgttttcatggccgtagaaacaatattcagccgcttgtcaaaacaaatgcgggcttatataatatttgtaacttaaatgtctgtgaagggttaacaattgtccttttctagtggacaaaaggaagaaaggtggagtttctctttggaagcgattcgtattggactgttaggactgggaaccgtgggaagcggagtcgtcaaaattatacaagatcatcaggataagcttatgcaccaggtcggctgtccggtgacgattaaaaaagtgctggttaaagatattgataaaaaacgagacgcagacctgccgaaagaagtgctgacgacagaagtctatgatgtgatcgatgaccctgaggtcgacgtgattattgaagtcatcggcggtgtcgaacagacgaagcaatatcttcttgatgccttgaaagcgaaaaaacatgttgtgaccgcaaataaagatctgatcgccgtatacgggtcagagcttttagccgccgcaaaggaaaatggctgtgacttgtattatgaagcgagtgtcgccggcggaatcccgattttacgcacgctcgaagaaggcctttcctctgaccggatcacaaaaatgatgggaatcgtcaacggaacgacgaacttcatcttaacgaaaatgattaaagaaaaaagcccgtatgaagaagtgctgaaggaagcgcaggatctcggattcgcggaagcggacccgaccgccgatgtagaaggactcgatgccgcacgcaagatggcgattttagcccgtctcggcttctctatgaacgtcgatctggacgatgtcaaggtaaaaggaatttcccggattacggatgaagacatcagcttcagcaaacggctcggctatacgatgaagctgatcggcatcgcccagcgtgatgacaataaaatcgaagtcagcgttcagccgacactgctcccggatcatcatccgctctctgccgtgcataacgagtttaatgccgtttacgtgtacggagaagccgtaggcgaaacgatgttttacggcccggagccggaagcatgccgactgcgacatcagtcgtttccgatctggtcgcggtcatgaaaaacatgcgtctcggcgtaaacggaaacagctttgtcgccccgcagtttgaaagaaatctgaagcagccgtctgatatctacgcccagcagtttttaagaattcatgtcaaagaccaggtgggctctttttcaaaaatcacatcggccttctcagagcgcggcgtcagctttgaaaaaattctgcagctgccgataaaaggacatgacgatctcgcggaaatcgtcatcgtcacgcatcatacatcggaagaagatttcagtgacattctgcaaaacttaaatgatctagaagttgtacaagaagtaaaaagcacatatcgtgtagaagggaacggttggagctaatgtggaaaggactcatccatcaatataaagaatttctgccggtgacggatcggacgccggccctgacattgcatgaaggcaacacgccgctgattcacctcccgaagctttctgaaaagctcggaattgaactgcatgtgaaaacagaaggcgttaatccgacgggatcttttaaagaccgcggcatggtcatggcggtcgccaaagcgaaagaagaaggcaatgataccatcatgtgcgcctcaacaggcaacacatccgctgcggctgccgcatacgcggcgagagccggcatgaaatgcatcgtcatcatcccggacgggaaaatcgccttcggaaagcttgcgcaggccgtcatgtacggtgcggaaatcatcgcgattgacggaaactttgacgacgcgctggccatcgtccggtcgatttgtgaaaaatcaccgattgcattagtgaattcagtaaacccttaccggattgaagggcaaaaaacagcggcctttgaagtatgcgaacagctcggcgaagcgccggacattctggcgatcccggtaggaaatgccgggaatatcacggcctactggaaagggttcaaagaatatcatgagaaaaacggcaccggacttccgaagatgcgcggttttgaagcggaaggttctgcggctatcgtccgcggcgaagtcattaaaaatccagaaaccgttgcgacggcaatccggatcgggaatcctgccagctgggacaaagccgtgctcgctgcggaagaatcagccggaaaaattgatgaagtcacagatggagaaatccttcacgcttatcagctgattgcccgtgaagaaggcgtatttgccgagccgggctcctgtgcatccatcgccggcgttttgaaacaggtgaaatccggtgaaattccaaaaggaagcaaggttgtcgcagttttgaccggaaacggcctgaaagatccgaatacggctgtggacgtatctgacataaaaccgatcacgctgccgacagatgaggacagtattctggaatacttaaatggagcggcgcgtgtatgaatgaggcggagatgctgttttccattacggttccgggaagcaccgccaacttaggacctgggtttgattccatcggaatggcgctcagcagatatttgaagctttcggttttccgaaacgatgaatggcagttctcggcggaaaccgaaactgtcgcgggcatccctcaaggaacggacaacctcatctaccaagtcgccaaacggacggctgaccgctatcagaaagagctgccgcccgcccatgtcaaagtttggagtgacatcccccttgcgcggggtctcggaagcagcgcggccgctatcgtcgccgccattgagcttgcggatgagttatgcggcctgcagctgtcggaaagcgacaagctgcacttagccagtcttgaagaggggcaccctgataatgccgctgcttcccttgcaggagggcttgtaatcggccttcacgaagaagatgaaacacatatcgtgcgtgttgccgaagcggatatcgatgttgtggcagtgattccgttttacgaagttctgaccagggacgcaagagacgtgctcccgaaagagctgccgtaccgacgcgccgttaaagcaagcgccgtcagcaaccttctcgttgctgcgatcatgtcaaatgactgggcgctcgccgggaaaatgatgagaaaagacatcctccatcagccgtaccgcgccatgcttgttcctgagctttcaaaggtggaacacgcggccgaaatgaaaggcgcttacggaacggcgctgagcggagcgggaccgacgattcttgtcctgattgaaaaaggaaagggagaagagctgagaaaacagctttctgagcatttccctcactgtgagattgcggcgcttaccgtcccgtcagaaggaagcgtaattgaacggaatcctttagagcaggtgaaaagtgtataatgataaaaaagcgttcttcccatcagagaaggacgctttctttttctggagaaggatttttatttagggaagcgaaataaaaaagaaaaggaggagatacgattgaaaaaactcataaccgaggaggacattgcgtcactcgtatccgtgacagacccgcaatatgcccctgacggcagaagagccgcttacgtccggacaacagtcaatcataagcgtgattcctattcctcagccattatggtatatgacacagaatccggcatctcaaacccgtggactttcggggacgataaaaatacaagtccgcggtggtcgcctgacggtcggcgcctcgcctttgtttctgacagggaggacggcatccctcagctgtacatcatcgacgctgccggcggagaggcggaacaggctgccgatattccttggggcgtatcagatccgatatgggcgcccgacggcagatccgtgcttgtgtccgtcagtctgacatcagcggagcgcgccgatgagaaagaaaaaaagaagcatgacgagtatgagccggttgagattcaatcattaacatataaacgtgacgggaagggcctgctgaacggaagccggacacagcttgtgctgattcatcttgaaacgggggagattcagcagctgacagatcatgaagctgatcattatggcgcggccttttcaccggatggcaggcagcttgcgtttaccgccaatttatgcgagccgggtgacgccggaaagccgagcgatgtctatctgatgaatctggcggacggaagcctgaagcagattacgccgcaccgcggttctttcggttcctgcgtgttttcaccggacggttcttatatcgcgatgctgggccatgagaatgaatttcgcaatgcgactttagagaaagcgtggctgtacgacgtgaaaactgagcggctgtcctgcctgaccgacatgctggatgttcatttgagcgatgcgctgattgcggattcaatcataggaggagtgacgccccggccggtatggacaaacgacgggcagggcttttacgttctcgggagcgagcagggaagcaccggtatttattatatctcgattgacggcctcgtatatccgatccgattagaagaagagtacgtgaacggttttgcttttcatcctgatcagaaaagctgtatcgctgtcattgccaaacccgcacagccttccgagctttacagcatttcacttgaaaatggggaagagaggcaattgacattttacaatgatcggtttatagaggagcgtatcatatccgtgccggaaaagctgcaatatgaaacaaaggacgggctgacggtaaacggctggtttttaaagccttccgtttttgaagaggatcaaacatatccctcattctatacatacacggcgggcctcacatgatgtacggccatacgtattttcacgaattccaagtgctggccgcacaaggatatgctgtcgtgtatgtcaacccgagaggaagccacggctacggacaggattttgtcaatcgtgtcaggggtgattacggaggcggagattaccgtgatgtcatgcaggcggtggatgaagccgttcaggcgtatccgtttttagacagcggccgtctcggtgtgacgggcggaagctacggagggtttatgacgaattggattgtcggacagacaggccgttttaaagcagccgtcacgcagcgctccatttcaaattggttcagcttccacggtgtcagcgatatcggcttcttttttaccgactggcagctcggacatgatttgtttgaggaagcggataagctttgggatcgttctcctgtaaaatatgcatcccgcgtttcgacgccgcttttgatcctgcacggtgagcgagatgaccgctgtccgatagagcaggcggagcagctctttaccgcgttgaagaaactgaacaaaacgacgtcgttcatccgatttccgaaagctacgcatgagctgtcgagaagcggccatcccgaacagcggatgaaacgcatccgttatatttgttcatggtttgatgactatttgtaaaaataaaaaaaccaggctgtcatgcagcctggttttatgattaaaatacttgttctacttcaacgacacccggtacttcttcaagaagggcgcgttcaattccggctttcagcgtaatcgttgaacttgggcagctgccgcatgcgccaaggaggcgaagctttacaatgccttcgtctacatcaacaagctcacagtcaccgccgtcacgaagcagaaacggacgtaatttatccaatacttcctgtacttgctctttcatttcaacctcagtcatgagattcgctcctttcatatacataaaaccattatattcacagtaacggtaaaaatctaatgtttggtttgcaaagctgctttctccattatagcatatttaaacttgaacataaaaaccgttttttatacaaaagctgccccgtcctttgtatactggtgtaaaggggatgatatacatgacaaagccggttacgctcagtgtttacggcgctgaaacgctttgcgcaagctgcgtgaatatgccgagcgccaaagatacgtttgaatggctggaggcggcgctgaaacggaaatacccggagcagccttttaacatgcggtatattgatattgaggcaccgcctcagcaaaaggagacagaagagcttgcggagcgcatcaagaacgatgaatttttctatccgctcgtgctggtggaggatgtcattgtgggggaagggaatccgcatttaaaagatatatatgaagaaatggaaaagcgcggctatgtggcgggctcttaaaaatggccgctgatcgcaatcagcggcttttttcttatcagccgttatgatgcttgtacatccataaaaggcctgattttaataaacggggcacacgcccgatgagcggacggtcgttgacaagaccgaagcccgctttttttccgagtgaaccgaggacgcctttcagcttaaattgcggcattgtttccggcagctcttcattgttccagcgtttcaggaggatctgcacaatttgttccgcctgcgcttcagccagctgggcgctcggcgcatgcggcaggctcgcgcaatcaccgacgacgtaaacatgctcatcgcccggaagattgtgatgcggtgttaaaacgatgcggccttgcgggtctttttcagcgtccagttctctgacggctttattcggctgaattcccgccgtccacacgatggcatcggccggtattccttcatcatgattataaacgatgccgtcttccacttttgtaatattcgcattattgataatggtgacgccgtgttcttcaaaccatttctgaacgtacttgctgagtcttttcggaaagcttgataaaatcaggtcgccccggtcaaataacataatcttcagatcgtcacggctctctcttaattcactggcaagctccacgccgcttaatcccgctccgacgatagcgacagatgcattggcgccgaggttgttcagcttttgataggcttcgcgtgactgatcaatggtctgaatgctgtaagtatgttccggcgcgccgggcacgttatgatacttatcctcacagcccagtccgatcaccgcgtcatcgtaagaaatcggttcgcggtcatgaaacagaacctgtttgtttttcgtgtcgatggaagccacctcaccgtattgaacatccagattcggatgctcaggaaaagacaccctgatatgatgatcagaaatcgtgccggctgcgagcgcataatattctgtttttaagcagtgatacgggtttctgtcaatcagcgtgatggatacatctgacggaagctggttcggcagtaagcggtgcagcacccgcatgtttccgtaacccccgccgatcaagaccaattttttcataatgattccccttttgcccgaaaaatatggtagtcaatattgttacaaaataacgaactatgtaaaataacatctagaattatatcgaatttgatctaaaaccacaataatagttttaaaataacctacaaattgaccagaaaacacgcaatagtaaaacctttaacctgaattaatatgttacgataacattgagcgtgaaaccggatctttgacgaatagaggaaattccgttaggataaggtacatatgtgaggtgaaaccgcatgaatccgatgattgaattctgtgtcagcaatttagcgcgcggttcccaggaagcacttgagatcttagagaaggatccgaacttggacgtgcttgagtacggctgtttaagctactgcggaaaatgcatggagtccctgttcgccctggttaacggcgaagtggtcacggggggcacgcctgctgagttggttgacaacatatatacattcatagaagaaaatccgatgttttaatcagaggctccgaacggggtctcttttttattgcgcccgggttttggcaaaataaaaaatttgtagacagcaaaaataaatattgttatcttaataaagactttttttaaataaaattttagaggtggattcattgaatatcgtttgggggctgctcggggcagttgctatattagccattgcttttttgttatcagagaagaaaagcaaaattaacctgcgaaccgtcattgtgggtttatgtttacaaatggccttcggattcatcgtattaaagtgggacgccggccgggccgtatttttatggttctcaagccgtgtgcagcttctcattgattatgcgaacgaaggcatcagctttatttttggcccgctgttaaaagtgggcagcagcccggctttcgcgctgagcgttctgccggtcattatctttttctcagcgctgattgccgttttgtatcacttgaaaatcatgcagctcatctttcgcgtcatcggaggcggactgtcaaaacttcttgggacaagcagaacggaatcgcttgcggcggctgcgaatatttttgtcggacagtctgaatcaccgcttgccattaaaccgctgattgcgggattgacccgttccgagctgtttacgattatgacgagcggcctttcggctgtagcgggttcgacgcttttcggttacgccctgttaggcattccgattgaatacctgctggcggccagctttatggcggctcccgccggtctcgtgttcggaaaaatgttaatacctgaaacagaaaaaacgcagacgataaaaggcgattttaatatggacgaagaaggcgaaggcgccgctaatgtgattgatgcagcggcaaaaggcgcatccacgggccttcagattgctctgaatgtcggcgccatgcttcttgcgtttgtcgcgctcatcgccgtagtgaacggaattctcggcggaatcggcggctggttcggtttcaaacatattacattagaatccattctcggttacgtgttttcaccgatcgcatttgtaatcggcgttccttggcatgaggcgctcggagcgggaagctatatcggacagaaacttgtgctgaatgagtttgtcgcttattcaaacttcggtccgcatattgcggacttttctaaaaaaacgtctacgattatcagctttgcgctgtgcggatttgccaacttctcttcgattgcgattatgctcggcacactgggcggtttggccccaagccgccgttcggacattgcgcgcctcggattaagagcggttattgcgggaacactcgcaaaccttctcagcgcggcgattgccggcatgtttatttagtaaacgataaaagctccctgcatatgcagggagcttttatgtatgaaaaacgggggatatttgtattgtgtccgaggggaagagcttttatactaagtaaaagaaaaaaagttggaggccgatatgaattcattccgttttaccaagatgcacggtcttggaaacagttatatatatgtaaatcaatttgaagaacagctgccggaagaacggctggctgagattgccgttaaagtgtccagcattcacacgggcatcggctctgacggaatgatcctcatctgtccgtcagaaaaagcgccggtcaaaatgcggatttttaataatgacggctcagaagggaaaaattgcggcaacggccttcgctgtgtggcaaagtatgcatacgaacataagctgacagaagaaacgtcctttttcattgagacgctttcaggccttgtgaaagcagatattacggaagaaaacgggattgtgcgtgaagtcgccgtcgatatgggcgaaccgcgcctcaccaaaaaagagctgccgatgctcggcaatgaagatgaacggacgatcgatgaaacctttgtttttggagaaacggagctttccggaacagccgtatcaatgggaaacccccatattgtttttccggttgcggatattaatcaagcgcctcttacaacgctcggtcccgtcattgaaaaagacccgagatttccggaaggcgtcaatgtcgaatttgtggaaaccgtcagcgccgatgaacttcatttccgcgtatgggaacgcggctccggcattacacaggcttgcggaacgggcgcctgtgcggcggctgttgcatccgtattgaacggtgtttccgaacgaaaccgggatatcaccgttcatttagcggggggcgatcttgtgattaattggcaggacaacgggcacgtgctgatgacgggacccgccgaaaccgtatgcagcggcgtctattatttgtaaacagctcgtttgagaaatacgctcctcaaggtttataatagatatcagcatccgtttttaaaaaaggaggtctacttatgagtgttccagtaactattactgaagcagcggctttgcatataaaagatatgatgaaagagcatgaagaagaaaacgcgtttctccgtgtgggcgtaaaaggcggcggctgcagcggcctgtcttacggaatgggatttgagcacgaaaaaggcgaaaaagacagcatgtttgaacagcacgggatcaccgttttggttgacagcgaaagccttgatattatgaccggcacgatcattgacttcaaacagtccatgatgggcggcggtttcaccattgacaacccgaatgccatcgcttcctgcggctgcggatcttctttccgcacggccaaaaacgccggtacgccggaagagtgctaagggtcagcccgccattctcaggatgaaaaaataggacgcctttcttttcgatggcgcttgcaccattgttaaaaaaggcgtttatctgtttaataaaagcaaaacccgctcaacagaagcgggttttgctttttcaaagaggttattcaattgtatgtttcatcgcattgtacatatttgccgtatgttcatcggctttatcccgtgacatgcgcagccgttccgctgaagaaccgtaaccgatttctagtttgccctctttcagtcctttaaaaatcccatcagcgaattcatccagcggttctccttgagtatgcagccctgctccgcctaaatctgtatttaccgccggaggcgcaacttcaatcacttctacagatgaatcagaaagctgatgtctcagactcattgtaaatgaatgaagcgccgctttcgttgctgaatagatcggtgcaatagcaagcggtgtaaaagccaatcccgaagagacgttaatgacagccgcatcttcttttccggcaaaaaacggagcgaacagcatagacaggtggaagggagcttcaatgttcgttgtgatttctttattaaaatagtcccaattgtccttcgcatccgctttcagcacatgaaaacgatgttgaatccccgcgttgtttactaacacattcacttccggataattttctttcacccaatcaaacagtgatacacgttcagatggaatgctcaaatcactgacataggtaataagatccgggaatgtttcctttgctttttgaagagcgtgcttacgccgtccggtcacgatgactttatttcccgcttttaaaaaccgttctgcgaaagccaatcctattccggcatttccgcctgtaatcagtattgtatttcccgtcagtttcatattaactcctcttttccgattgtttttacttcaacaaacttacgtctcttgaacagagcttttgatataagcctttgtcattgacgacatttcatccagtactgaccgcttgtgtctcctcatcatgtcaagccggagtttaataggactctctccttcaattacccaatcaatatattgcttaaagcctttgatggtcatgcgggtattttttaaacaaatcacgatatcaaggagcggcatttgatctgctgaaaataaccgccggctggcttcatcacgttcaatcagcggcagcagtccctttttttcataataacgtaacgttgattctgtcatattacactttgctgctgcttcacgaattgaacaacatgtcttcgaaagacctccaacagtattttttccttgtcactgggtgatgatacgacttaaaccatgttttaagtcaataaaaaaaatgtgatgaattcagacatatgtcacaaaaggaaatgggcagattttcaataggtttaggagtgacggccttcacaaaaatcctcaaatcaacggttcaaatcatactatttgcaaattcggaaaaaaataaagggtatatagaatcaaaaaatctggaagatgtgctcttagtcaacacgttctaaagtcatatttttcgaaaggatattgattttttgataggaataaactaaattgtaaaagtatagaatagttaatttattttgtaagaaaaggatgataatatgataggtcaattgagcaataaaaaaatatttttaagttcttttttcatcattttgatctgttcattactcttccaattcagtatttccgataaagttctgcagtcgtattattcttccgtcggagaaagtacctacgatatcggggagaaaagtgttcgtacgattgtcatgtttctgcaagggtttatgatcttcacaacttttgtggaaattctgataggcggatttctattattcgttgccgcttttattctcggtacaaaaaaaccgaaaaaaatatatttgcttctatatacactgacttctttaatctcggcatttaaaatgttgattctttcagttgttaactacttaacggctgattcctcgcttatatattctgccggcggcaccagcttgagtctgcagctgctggatccatttctgctcatatcaattgcggctctttatgctgccgcaggaaaactgaccgatctcagtaaaggcaagagaatcattttgactggatgttttgttttattaaaactctttactattttctttaattattttatggcggataaaatttagctcgggagagagtcaattaagctgaattttattataaattaaaaaaacagagtagggagatgttatgatgaacttagtaaaatctaataaaaagtctttcattttgtttggcgtggctcttgctgcagcaacattggtttatgcactattattaacgggaactgaattaaacgtggcggcggctcatgcattctcagccaatgctgaattagcttcgactctgggcatctctacagcagcagctaaaaaagcaattgatattattgatgcggcatcaacaattgcttctatcatttctctcatcggtatcgttacaggcgcaggcgcgatttcttatgcaatcgttgcaacagcaaaaacaatgattaagaaatacggcaaaaaatacgcagctgcttggtaaaatcgaccaataaataattgctctttttgtacaagctgcaaaaagagcctctctcccaaatacatatgtaaggattgaaagtatgatagtcaaacaaattgcggctcttatcaaatataataccctgtcatcgtttcgaaaaagaaaggaagattggggcattcctcaactcaacagcaaactgctgtctgccattattatttctctgttatgtttatatctcgttttcctgggatgcggtgttgtattcgggacaaaactgattcagctgcccctcagcgcatgggggcaatttgttttaatcgccgtttcacttgagcagcttttttgggctgccggcttctttaaagaacatcacaatgcctttctgctggatacgcgcaaggtcattcatcaattaaaaaaggtgcgttttttacagctgttttctgtttttgccggccaggcgatcaaaaaaaccattttcgtatggtatctttttgtttttccggtctttttgtttttatcaagcgcaggcatgaccgggtctgcggcgatcatcgtatttttcttgggcttcgtttattttcttctcaatttatttttatctatgctgttttcttatgttgtttatcttcttacaaatatatggagcaaattgttttacttgaaaatcctgaaaggcattttattcagcgtcagcctgctggttccgcttgcagtcgggtatgccgtttatcttctcgtgtttggggagtataccgcaaaggatatttcaagctttacggagtcaccggctttccggaacatcctcatgaatacgccgtatgtatggttagcattccgctcacattccgtgctcgttttcgctgcggtgtttgcggccgccgtccttttaacggcggggatgtttaaactgtggtcggccacgctgaagaaaatggaccttattccttatatgtttttgacaaacgctgattttgcgccaaagctgaaattatatagaaataacaaaatatttcatgccgtttttcaaaaggatctgctgtttttatcgagaattgacgggttttttatcaggaacttcggcagtatgctgtatttgttcatgctgtttttaggtttttgtattccgcttctatcgcatcactttatcgggtattcggcagccgccatcgtgtctgcggcggttatcattgcgaacttttcgtatcagctcgtcggagatgcgctcaaaacagtattatcagttgacggggaaataaaaaatcagcatctgtttcaccggaatatcaaacatgcgtggcagctggtgtttccgaaagtatgtatttataatctcgccgctcttatctattcgttcatcatcaccattttgattacggtgttttttccgtcttccgcggcgctgacgatttacctgtttattgtgtttttatgttcgggttttttatacagtctcgtccagatttcaagcaccgccctgtatcctaagaaaaactgggagcatctgtacgaaattggagaagcggggaaagcaaagacgtataacaacttatacagttctttcattttcattgtgtcgcttcaaatcgctgcgatcacgtcctattttatctataaaaagccggaacttgaaacgatgcttattcattctgcatcaggtatttttgtcctgttcacactattaaactatggagtcatgtttctgtttcttcgcagaatcaatatggcggaaaggtttgcgaacaatgattaaattagtgaatatacaaaaaaactatagtgaaaaacaggtattgaaagatatttcgtttgaggtgaaaaaaggctcaatctatgctttgctggggactaatggagtcgggaaaacaacgactttgaaaatcatttcgggcctgcttaaaccgacttcaggccgcgtcatgattgacggcaaggaactggattcagaagagggggggcaaatatcggctgatatcggttttgtgcccgaccatgcttttttatatgattacttaacgggagtcgaatacttgcgttttacagcggaaatgtttcaagttccgtctcagcggacaaatgattatataaagaatatgttggagacgctgaagctttctcaagacggaaatcagctgattaaaacttattcacatggaatgaaacaaaaattatcaattgcggcagcgctcattcatcagccaaagatattaattcttgacgagccgctgacgggcattgatttaatcagcggtaaaacgatacggacgttattaaaggagtacgtcaagcagggaaatacagtcctgttatcgactcacctgctggagctggcgcattcgctgtgcgatacgatcggtattatacatgaaggcgtttttgcggcggagtatcagtcatccgagcattcattagaagagattgaagaattggctgagcgtatctatacatgatgaaccgcatgttgccggcaatcagaacgtccgccattccgttaaccgcgtcagtgctgtttttttcaggcggtgtgatcgctgcgtttttttccgatcactttgtttcatcagcgtcttacaacggctcgtcaggcgcggttgaactgctgaaaaacaatgcaatcgcttgtctgtttttagccgcgggtttttttacctttgggttgacctcaatcttttatttattcaccaacgggtttattttaagcggctctattatagaaaatctgcatagcggggttcctttttatcagatttttttactgctaattcctcatggtatatttgaagttcctgcgttattattaagtggcgccattggttttaagggcgttgaattggtcatcaggctgtgtttttctaaggaaaaaaagataatggtttcaatgttcaggcatattggaatattggtgctgcttattatttgtctgctgatcgccgctgccgttattgaagcttacatcacaccaatttttaagtaaaaggggcagaaatcatatgagaagtaaattatcattaatcggtgtgccgattgttatgattatcggttatatcatttctttatcctttgagtggctgtttcctgttcttacttttggggtggcaggactatatctctttatatttgctccggtgcaaaataaattcattcgttacatctttttgtttatttttgtgattaatctgttagccagtgcggctctttatttcggtatttaataaaaaaatgacattcaatatgaatgtcatttttttttatcttcgagcggctctgctgcatgttaaaatctgtcgccgttgaaaatagagttttttacgattacatagtcgacattacggatggcttcgagtgtattgccgccggcgtaagagatggaagattgcagatcctgctccatttcaaccagcgtgtcctgcaaagaccctttatgttcgacatgcatttttttgccctcgacgtttttcttttcgcctttttgaaattcagaagcggagccgaaatattctttgtacagctttccgtcgatttcgatcgtttgtcccggtgattcttcgtggccggcgaataatgatccgatcatgaccatagacgcgccgaatcggatggatttcgcgatatcgccgtgcgtgcggatgccgccgtcagcaatgatcggtttgctcgccgcttttgcgcaccagcgaagcgcggctaattgccacccgccggttccgaagccggttttaatttttgtgatgcagactttcccggggccgattcccacttttgtcgcgtcagcgcccgcgcgttccagctcccttacggcttcaggcgtcccgacattccctgcaatgacaaagctttccgggacatgttctttaataaattcaatcatgctgatcacggcattggaatggccgtgcgcgatatcaatggtaatataatccggcaccagctcctgttctttcagctcccggatgaattcatagtcattttccttcacgccgacactgatggaagaaatcagtccgcgcgctttcatatcccggacaaaagccagacgtttttccggctcgaagcggtgcatgatataaaaatacccgttttccgcgagccaggccgcgatgttttcatctataatcgtctgcatgttggccggtacgaccggaagtttaaacgtgtgtccgcccaacgtaactgatgtatcacattcagatcggctttcaacaatgcattttgcaggaatcagctgaatatcttcgtaatcaaatacattttccatatataacacccctaaaagcgaataatatatttaaataaaattaaaatgttcgtctttttataatgtactttgttttgtcaggaatgtcaaatgatttcatgctgcctcatatgcggtcagcttgtcatccatttgcagtttggttatcatagtagtattggttgttgtaagacatttgttacgatagatagatttgcagaagaagggaggggccggtatggaacaaaaacagcccgggcacagcccgaaagcccagaaaattcaggaccggattattttaggcacgatttgggtcgtgtcggcgcttgtcattgcgctcgttgtcggaaccgtcatgaattatatttggatgtttaaataaaaaagagtctgtgccggtatgacacagactcttttttatattatttttcaaacatgcttgtagaatgcagtggctggacgcgcgctttcgggtccatgtaagccttcgcgttgttcacggctgtcggagcttcgccgaaaccgctggcgatcagcttgactttgccttcatatgtgcagatatctccggcggcaaagaagccttcaatattcgtttccatcgtgcttttgacgacgatggaatttttctcgatatcaagaccccagtttttaatcgggccgagagaagaaacaaagccgtagtttacgatcaggtcatcaatttcaatgatttctttacggtcgcctttcacttcttcgagaacgagctgttcgatccggtcttcaccgacaagttcagcgggaacaaacggtgtcagcacgttgactttagaattatgcaggttttcgacactgtgctcatgcgcgcggaatttatcacggcggtggatgatgctgacttctttggcaatcggctcaagcatgagcgcccagtcaacagcggaatcgccgccgcccagaacggcaacgcgtctgcctgcgaattgattgaggtcgtcaatgaagtagtgcaggtttttgccttcatattgttccgctgattccagctcaagctttctcggcttaaatgcgccgtttcccgcggtgataatgaccgtttttgaataatgcgtttctgaattcgtgacaagcttaaacacaccgtccgcctgtttttcaacagattcaacggcctgctctaagcagatggtctgatcgaactttgccatttgctcttttaagttgttcacaagttcctgggcgcggattttcgggaatccggctacatcataaatatatttttcagggtacagcgcgctgagctggccgccaagctgaggcaggctctcgatgattttgacgctcgcctgtctcattcccccgtaaaaagcggtaaacaggccgaccggaccgccgccgatgaccgtaatatcataaacctttgaatcctcttgcataccaaattgcctcctaattgaaaattgttattaattataacatacaatttgaaaggatgacgagtgccgaaaaccgcccggccgcttcattcttgaaaaaaattgcggccgccgctaagatggggacaaattccaatctgttttttcctgaatgttttccgattcttccggatagtatggtgatatgcagacatgtgcggttttctaaaaaattttatatttcatttcataaaatcccgccaataagctgaagctaatacaaatgttgatttgattatgcgtctaacagcaaaaaaaagaaggtggatgtgatggcattgaataaacccaaaatcgtggttttaggtgcaggttatggtggattaatgacagtaacaaggcttccgaagcatatcggggcaaatgacgccgacattactttggtcaataaacacaattatcattatgaaacgacatggatgcatgaagcgagcgcaggaacgctgcatcatgaccgctgcagatatcaaataaaagatgtaatcaatgaatcacgggtcaaatttgtgcaggataccgtaaaagcgatagatgtgcaaaataaaaaggtgacgctttcacaaggggacatcccttatgattatctcgtcatcgggcttggcgccgtccctgaaacattcgggattaaaggtttaaaagaattcgcttttccgatcgcgaatattaatacgtcgcgccagctgaaagaccatattgagctccaatttgcgacatacaatacggaggccgaaaaacgccctgaccgcttaaccatcgttgtcggcggagcgggctttacgggaattgaatttctcggtgaacttgcgaaccgcaagccggagttatgcagatattatgatatagatgaaagtctcgtccggatcgtctgtgtcgaggccgccccgacggttttgccgggatttgatccggagcttgtcgattacgccgttcaataccttgagagcaaaggcgttgaatttaaaatcggcaccgcggttcaagaatgccgcgcagacggtgtcacagtcggcaagaaagatgaagagccggaagaaatcaaatcgcagaccgttgtctgggccgcgggtgtgcgcggacatccgatcgtggaggaagcgggttttgaaaatatgcgcggccgtgtcaaagtcaaccctgatcttcgggcgccgggacatgatgacgtttttattctcggcgacagctcgctctttatcaatgaagagacggaacggccgtacccgccgactgctcagatcgcgatgcagcaaggagaaacggtcgccaaaaatctgggcggtttgataaaaggaggccagcttgaagagttcaagcctgacattaaaggaacggtcgcctccctcggtgagcataacgccgtcggagtcgtatacggcaggaagcttaaaggcacgccggcgtcctttatgaaaaaggtcattgataaccgctcgctctttatgatcggcgggctgggcctgacgctgaaaaaagggaagtttaaattcttctgaaaacccgcagccgcgggttttctcttcttttaaaaaagagcgctataaaaagcatgtaaaagaaaaaaaagaatgtttccgcttacatgagttgttatgttacatattctgacttggtgcttgacaagtaaatatgatatattatcagaaaattaagaaaaagggtgatccgcatgaaaacgacagcaaaaagcacggcggcgtgtccgttctgctcaggtaaagggtattttcaattgcttcttggcggctccgaaacatgtccctcctgccagggaagcggcaaagagagacgctgatttttccagacgttgacttttttaccgccccgaggtacactgaaagtgctgtagggggtggatgtttgtgattagtttgccggttgtcctgatctcaatcgtactattttttgtactgtttttcggcataggctttctgttgaacatgctgcttagaatgtcgtggattatggctgttgtctatccgattgtatgccttttcattatcagcaataaaaagatgatcagttacgtgcaggcgccgggggaatcctttcaaagcctgtttcagcgcatcatgtcattagcggttgcggatgtcgtgattttggcgggcggactggcgggagccatcatgtcaggcattgccataaaggcgctcagaaaaagaggatatcaaatgttttaaaccgctttcttattcaagaaagctttttttgtgtcacggcgctttttgtatagcacctcaccgagttgggaacaatgactcggaggagagtgatttcagattgacgataatcagacgcgtattcatgatcgtgctctttttgggcgcatgccatgcgacatacttttctataaccggtgttgaagcaaaggatctgacaaattggatgacggaacatcgcggcgccgttttgaaaaacatcggcactccgtttcaatccttacagaatcagccggaaaagaaggcatcaggcagggtaaagccgctggaagaagcttttgactgggaacgctatccgtcacaaaaagtgacggccaccggttataccgccggagcggaatctaccggaaaatctccgggtcatccgcagtacggaattacatattcaggtgtgaaggtcaaacgcgatttatattcaactgttgcggccgatccgtctgttttcccgatcgggacgattctgtttataccgaattacggttacggggttgtcgccgataccggctcaaaaattaaaggcagccgccttgacctctactttgacaccgtcaaggacgtctataacaattggggcaaaaaaacacttgaggtctacattattaaaaaagggaacggcacagtgaccgaggacgaacttgtaaagctgaacgaaacaaagtcgctgcaagtgttcagaaatcaatacaaaacggtaaaagaataaaaacgcttcagcatccgctgaagcgtttttacataaagaaataatctaaaatcaatgtcagcacaataccggtgacgccgccgaagaacacttcaatcggctgatggccgagcagttctttcagtttcttctgtttttctttctcttccgctttctgaaagtccttcgcttcgctgacaaaccgattaaagtcgatgaccagtttattaatgactgtcgcctgttcacccgcatgccgcctgacacctgtagcatcgaacatcgtaatgacggcgaaaatcgcggcgactgcaaacaggggcgagtccagtccctgttccaaagcgattccggttgacagcgcggtgacggcggcggaatgggagctcggcatgccgccggtgctcgtcacaagagaccagtcaagttttttggatacgataaattgaataggcacttttacaacttgggcaaaaataatggcggcaaaactcgccagtaaaggaaaattcataagtacatccatatgcgacatcctttctgtatctgctgattccgatcgtatcgaaaaactgcagaaaacgcccttagtttggtaaaataaaatcaatgaaaaatgttttttcattataccactttacataacaaatacccacataaggagtgtgtactcatgttttatgcatctgatcaactgcggcatcccgaaacactggtcatcggtctttttcaaaaaagcacgctgaacggatttacgaaggaattggatgataaattagacggtcatctgacccagctgttaaaggatggtgatgtgtccgccaaacgcaatcgtgtatcaaaagtataccctccggctgcgaccggtatgaaacgtatttattttatcggcctgggaagagaagcggattattcgtttgaagatacgaaagaatgctttgcacgagtatttcagcagattcatcaagataaaaaacaggaagtatccgtgttgctcgatacattcgtctccggggaagtgcctgccgccgatgccgctcatgcgctttcggaaagctgtctgcttgcggtttatgaggtgcaggattataaacataaatcgaatgagccggatcaggaactgaaatcagtctgcgccgtgaccgaagaagacctgagggaagtgcaggccggcctgaacgtcggcgcggcatacggccaagggacgaattcagcccgcacgcttgtgaatatgccgggtaatatgctgacggccactgatttggcgtcatatgccgctgagcttgcggcaaaatacgatttcgagtgtgaaattttagaaaaagatgaaatggaagagctcggcatgggcgggctgcttgccgttaacaaaggctcatccgaaccgccgaaaatgatcgttctgaagtatcagggcaaagatcagtgggaagacgtcatcggcctggtcggtaaaggaattacctttgatacgggcggatattcaattaagccgaaaaccggcatcgtcggcatgaaaagcgatatgggaggggccgcctcggtattgggcgcaatggaaattatcggcgaactccggcctgaacaaaacgtgctcgccgtcataccgtctacggacaacatgatttcgtccgatgctatgaagccggatgacgtcatcgtttcgctcagcggaaaaaccattgagatcctgaacaccgatgcggaagggcgtctcgtgcttgccgacggcatcacatacgccaagcagcacggagcctctgtccttgtagacgtcgcaacgttaacgggcggtgtcattgtcgccttaggtaacgaaatgacgggcgccatgaccaatcacgccgcgttttatgaacaggtggcggaatcggcgaaagaatccggcgagccgatctggcagcttccgattacagaaaaggataaaaaacgggtgagaaacagtcagatggctgatttgaacaattctccgggaagagaaggccacgcgattatggcgggggcattccttggtgaattcgcggaaaacacgccgtgggttcatctcgatattgcgggaaccgcgacggcgaataaagcgacatgcttcggccctgccggcgcaacaggcgtcatggcaaggacgttggctgttttgactgagcggtttacgcccgaaagataacagcatcccgctgccttgatgcagcgggttttttgatttccaaaatctttagttgactaaagcgcagaatgtatgttaactttaattatctactacattagcaaactaaaggatttttggagggactcatcaatgaatgctgttgttgtcgcagtattgcttatgctcgtcttaagcctgctgcgtgtcaatattattatagctttaatgatcggcgcgcttgccggcgggctgaccggcggcttaggcctcggagagacggtgaaggcttttacggacggtctcggcggaaatgccaccgtcgcggtcagctacgcgctgctcggagcatttgccgcggcgctgacgaagacggggcttcccgatgcaatggtggaagcgtctgtcaaactaatcggaaaaaaggaagattcgcggaaaaaagcactgtcaaaagtgttaatcgtactggttattttaatcatatcctgtttctcgcaaaacgtggtgcccgttcacattgcgtttattcctgtattgattccgccgcttttaaaaatatttaacgaacttgaaatagaccgcaggctgatcgcgtgtgtgatgacattcggactgactgcgccgtatatcgttctgcctgtcggattcggacagattttccaggggatgctgagagataatatggcgtcagccggtttaaaggtgccgctcagtgatattccgtatgctttaatcatcccgacggccgggatggtagtcggtttaattttatccgtcatcgtcttccggaaaccgaagaaatatgagacgaaggagattgccggactgtcgtcttctccttatacgaaaaaaagcattgccatcgccctgatctccattgccgtgtcgcttgccgttcagctctatctgtcacaagtgctcggagtggaaggtatgatcatgggcgcgcttgccggcttgtttacgctgtttatcagcggagtcatgaagcgcaatgaagcggataagctgatcacggacggcatgattctgatggcttttatcgggtttgtcatgcttgttgcggccggtttttcaaatgtattgaacaaaacgggcgatgtggcttccttggtcaaagcatcaacaggctttatcggtcacagtcaatcattaggcgcgctcctgatgctggtggtcggtttattaatcacgatgggaatcggatcatcatttgcaaccgtacccgtcattacgaccatatttgtcccgctgtgcgctcagctcggattcagcccgatggcgacgatcgccgtaatcggagcggccgccgcggtcggtgatgcgggttctcctgcaagtgacagtacgctcgggccgacgtcaggcctcagcgccgacggacagcaccaccacatttgggatacgtgcgtaccgacatttattttctataacattccgcttgtgatattcggctggattgccgcgcttgtcctgtaaaaaaaggctcccggaaaggggagcctttttgtatgctgagaacatcttacgccggatttctgctgaaccccgtcgctttatgaatagacctgtatacggcaggcgcgattgatgccaataacagtgctaaaacgatatcttttatgaaaaaccatatcatgtaaaaccaggccattccgtagctgatcggagcatgaagccataatttcagcgcaatatacgtataggtcgtgccaatgatataaatgacggcggtaccgatcaaagaggcccatgcataatgcaggcggccgggtttttttgttttttccagcagccatccggctgcaaatgccgccgggatgtaagcgagaataaacccgccgctctttccgataaacggcgcaaagcctgctgagaattgagcgaaaacaggcgcccccgcgagtccggccaatgcgtataccgtcattgcaatggctgcccgtctggcgccgagaagcatcgcggctaacagacaaaagaaaggctgcagcgataacggaattcccgcaacttgcaaaaaaggagccattgatgtaatgttggcgccgacggccatcagggcggcaaacatgccgatcagcgccatatcgcccgcgcgaaggttgcgttgtgtcatttgtttttcccccttacacttgtaccagattagcgtaatcgaagggtgattgattgtcaacaaagatttaatacaggtttactaaatggagggagccatatgtttttcgggaaaacgaaacaaacaaaacagtcggaacggattccgccaaatcaaaatgtcacaacgaagtttcccgtgcttcacgccggaaatgttccttattatgaagatatgtcaaaatggaatctgcaagtgtacgggcttgttgaccgtcctatgctgttaagctttaaagatatcaaagcctttccggaagccgaagtgaaaaatgatattcattgcgtcacgggctggtcccgtcttgataatatctggcagggaatacgcgccaaagacatcgctgagaaagcgggtgtgcacaaagaagcgggattcgtcattctgcacgctgaagagggctggacggccaacctgccgctttctgattttacgcgggaaacatccctgctggcatatgcgcataacggcgagccgttaacgccagagcacggctatccgctcagaggcgttttcccccatctttatttctggaaaagcgcaaaatggctgcgcggcattcagtttacaaaggaaaaccaccccggcttttgggagaaaaacggctaccatatgaggggagatccatggaagaatgagcgctttacatgggattaagcccctatccctatatagttcttaggtaccttattaaaataaggtgctttttttatatcaaaaatccattgactttgtttggcaaaaaacctattatttgaggtgtcttttgatattgaaaatcattatcaatgaggatagataaagtaattgccacaaaggggatgaacacataatggacggaaaacaaataaaccgggggttcgcgccggccggccgatacgcggttccgggcacagaagtaagagaaatgcgctcaaaaggaggccgtacgtatcgtatctttgtctcttttcctcaggaagaaccgcctgcctccggcttccccgtcatctacctgcttgatgcaaattccgtgttcggtacaatggccgaagctttgcgggtgcaaagccggcggcctgaaaaaacaggcgttgttccggcggtgattgtcggaatcggctacccgacagatcagccgttttccgccgaacggcacagtgattttacgatgccgctttctgaatcagaactgccggtgcatccgcgcggcgcggcatggcccgaacagggaggggcggaagcgtttctggagtttatagaagaagaagtaaagcccgcgatggagcgggattatccgatcgacagagacaggcagacgattttcggccattcgctgggcggtctttttgtgctgcaagtgcttttgacgaggccggacatgttccagacctatgttgcgggaagtccgtcaattcattggaacaagcgttttattcaggaaaacgcagaacgtttgtcagaccggctctctgcggaaaatcttcaagtcagtgtattgctggctgcgggagaaattgaaaaaacacataaaagcagaatcccgcagcacgcagaggcgctgtactctttattatccggatttgaagatgatggagtccgtgctgaatacagcgagtttgaaggagagggccatatttctgtcctgcccgttttaatcagcagagccctgcgtttctgcctgaatccgggagggccgcataccccgtattctcccacatgagaaaaaacaggcccttcgaactaaatgcggctgattctaattttctaattgactgcgtgttttgatttggatatgattgtcttgaatcataattgataatgataatcattatcaatatagaaagggaatgataatatggacgcattgggaatgaaagggaaaacggccgttgtcaccggcgccgctcaaggcatcggagaagcaacagcgcttgcccttgctgaacaaggcgtaaatgtggcagctatagatacaaatgaagacctgcttcccgggctaactgacagacttcggcaaaaaggcgtgcaggcgcaggggtttgccgcagatgtatctgacagtgcggctgtcaatgatatcatcgctgccgttgaacgtgacatggggcctattgaaatattggcgaacgttgcgggcgtgctgcggccgggtccggtgcaatcccttagtgatgaagattgggatcaaacattttctgttaatacgaccggcgtatttcatgtatcgcgggctgtaagccggtacatgattgagcgtcaaaaaggcgccatcgttacggtcggttcgaatgcagccggcgttccgcgtgcttccatggcggcttatgcggcgtcaaaagcggctgccgccatgtttacgaaatgcctcggactggagcttgcggcccatcatatccgctgcaacatcgtatctccgggttcaacggaaaccgacatgcagcgggcgctgtggcgggatgaaaacggagcacaggacgttatcagaggttcgcttgatacatataaaacgggaattccgcttcaaaagctggcaaagccttctgatattgcaaatgccgttttgtttctggcctctgaacaggcaagccatatcacgatgcatgatttatgcgtggatggcggcgctactttaggcgtttgatttaacgagaaggagggacaaacatgacaaatcaacatgtattgacggaagtgtctgcaaaagaggtgctggacgcttacaagcccggagcgttctttttagcttccccgaaaaggacgctccttgcagaaggtgtgtttgcaaaagtgccggatgcagacgcggagaatcagctggattcactgcctgaacgcgtaagacagacgcttcttgaggcaaagcaagccggcatcaaacatccgattgcggccggcgccattccttttgacggcagaaaagcttcccggctttttgtaccgaagaatgtccatacggcaggcccgctttcgtttgcggaatcttccgcagaaaagccgcaatccaatacatatgacatccgtcccgttccggagcctgagggctttatgagcggtgtggaacaaggcgtattcaacattacggacggcccgctcagcaaaatcgtgctgtcaaggacgcttcatctgaccgctgaaaaggatatcgacattcctcaggccgtcaagcatttggcgcagcacaacccgcgcggctatacattcgcttcggatgtgacgggaacgtcagaaacaagaaaaacgcttttcggcgcaagtcctgaactgctgctgtccaaaaacggaacatcgattctgtccaatccgctggcaggttccagacctcgcagcacagatcccgccgaggatcagagaagagcggaagaactgctgcaatcagcaaaagatctgcatgaacatgccgtagtcgtggccgccgtggccgccgccctaaaaccgttctgccgtgtgcttgatgtgccggaaaaaccgtcactcattaaaactgaggcgatgtggcacctgtccaccgaggtaaagggagagcttagtgatccgtcaacgacatcgcttgagctggccatcgctcttcatccgacgcccgctgtatgcggaacgccgacggatgcggcgagagaagcgattcaggatatagagccgtttgaccgcaatttctacacgggaatggcgggctggtgtgatgctgaaggtgacggagaatggattatcgcacttcgctgcgccgaagcggaaacaaggtctctccggctctttgcgggtgccgggattgtcgccggatcaaagccgcaggatgaactggacgagacatcggcgaaattccgcaccatgctccgggcgatggggctttaccaagatgagttgtaaaaaaggagggaacggatcgtgctgactggatttacgccatggccggaagaatgggctgaaaaataccgaaaagacggctgctggaagggtgagacgttcggaggaatgctgaaagagcgcgcggctttatacggaaatcaaactgccgtgacgtgtaaagatgtacattggacctacaaagaattagatgaaagggccgatcgtttagcggcggggctgcataagctcggaattcaaaaggaagaccgcgttgtcgttcagctgccgaatatcgctgagttttttgaagtgattttcgcgctgttccgactcggagcactgcccgttttcgcgctgccttctcatagaagcagtgagattacgtatttctgcgagtttgcagaggcgaaagcatacatcattcctgatacgcattcaggttttgattacagggcgcttgccagacaggtgaaagacaaacttccggatttggcgcatgtcattgtggccggcgaagctgaagagtttcaggaactgagcagcctgcatagagagcctgttcagctggaagaggtaagcccggcggaagtcgcttttttacagctttcaggaggcagtacggggctgtccaagctgattccgcgaacacacgacgattacatatacagtttgcgcctcagcgcggaaatatgcggcttggatcatcacagcgtttatttggccgctctgccgacagcgcataattatccgctcagctcgccgggtgtgctgggaactttatatgccggaggccgtgttgttctgtcaccgacgccgagtccggatgactgcttcccgttaattgaaaaagaacgtgtcacgattacagcgctcgtcccgccgcttgcgatggtgtggatggacgcatccggttcgcgaagtgatgatttatcaagccttcaagtgctgcaggtgggaggcgccaaattcagtgctgaggcggcccgccgcgtaaagagcgctttcggatgcacccttcagcaggttttcggaatggcggaaggattggtgaattatacgagactggatgatcctgaagagatcattgtcaatacgcaaggcagaccgatgtcaccttttgatgaggtaagggttttagacgatgacgggcgggatgtcgccccggagaagcgggacatttgtttacacgcggcccttacacgattcgcgggtattataaagcgcctgaacataatgaaagatcattcacagccgacggattttatcagaccggcgatatcgtcaaactgacggcggacggctatatcatcgttgaaggacgtgcgaaagatcaaatcaatcggggcggcgaaaagattgccgctgaagaggtggaaaatcaccttctggcccatcctgccgttcatgatgcggccatggtttcaatgccggatgattttctcggagagcggtcctgtgtgttcgtcattccgaaaggagaagcgccgaaaccgggagagctgaaagcgtttttacgggagcgcgggctggcggcatataaaattcccgaccgggttgaatttatcgcttctttcccgaaaaccggcgtcggcaaggtcagcaaaaaggaccttcgcgaaacgatcgcccaaaaattgaagcctgctgaaatcaaacaatcttaaaaaaggaagtgtttacattggctataccgtcaattcccgcatatgcgctgccgacagcgtcagatatgcctgaaaataaagtatcgtggacgctgaacccgaaacgcgcggtgcttctgatccatgacatgcagaattatttcgtcgatgcttttgagaaagggaaggctccgatcacggaggcggctcagaatatcaagaaaataaaagagcaatgcaaagcgctcggcattccggtggtgtacaccgcgcagccgggcagccaagacccggcggaccgcgcgctgctgacggatttttggggaccggggctgaaaagcgggccttatgaagaaaaggtcattccggagcttgccccggatgatcaggacattgtcctcacaaagtggagatacagcgcgtttaaacggacgaatctccttgacatcatgcgtgaaagcggcagagaccagctcatgattacgggaatttatgcacacatcggctgtctcgtcacagcctgtgaagcatttatggatgatatccaaagcttctttatcggagacgccgttgctgatttttcttcagaaaaacataagatggccatcgaatatgcgtctcagcgctgcgcttacacggctttgacaaacgaagtgctggagctgctgggcggcgcgccggtttctgaaggagaagggaagacttccgccgtattgacaaaagaccgggtgcgggaacaaattgcggcgattcttcaagaatcaccgtctgatattccggatcatgaagacctgctggacagaggccttgattccgtcagaatcatgagccttgtcgaacaatggcgccgtgacggagctgaagtgacgtttgttgaactggcggagaacccgacgcttgaagagtggtggagacttctttcttcccgatctcaaaaagtcttgccgaacgcagattatttataaagggagagaatagaatgcatgatacacaacagctgcctctgacaggcgcacaggccggtatctggtttgcgcagcagcttgatcctgataatgcgatttacaatacaggcgagtatgttgagataaacggcgcgatcgatgtgaacatatttaaaacagctctcgaacgtgtgctgacggaagccgtgtcattacacgcccgcttcgaagagggagcagacgggccgaagcagatcatcaatcctccatttgaagctgcgatcgatgtcatagatgtgagttcagaagctgatccgaagcaggccgcactcagactcatgcagacagatttggctgagcccgttgatatggcggccgggcctttgttccgcgacattttatttcaggcgggaccggaacgctttttctggtatcagcgcattcaccacattgcgatagacggctacggtttttcactgctggcacggcgtacggcgcaaatatacaccgcaatacgggaaggacgtccggataacgggcgctccttcggctctttggaggaactggtaaaagaagatcaagaataccgcgcgtctgatcaattcctgaaagatcgggaattttggatggagaaatttgcggatgaacctgatgtcgtcagtttggcagaaagagcgccgagaacgtcaacaagctttcggagaagcacggcttatctttctgaaacggctttgcagcatgtaaaagcaattccgaactggcatgaagccgtcacagctgcagcggcggtatatgtccaccggatgacaaacgcaggggatatcgtgctcggtttaccgatgatgggacggatcggctcgatttcactgaatattccgagtatggtcatgaatcttctgcctttacggctttctctccgcccggatatgaattttcatgaggccgtcagccaagtggcaaaagaaatccgaaacatccggcgccatcagaaataccgccatgaagacatgcgccgcgatcttaaattgctcggagaaaaccgcaggctgttcggcccgcaagtcaatgtgatgccgtttgactacgctcttgatttcgcaggagcgccaggcaccgtccataacttatcagccgggcccgttgatgatttgtcaattaacgtttacgacagagcggacggaagcggaatgcgtgtggactttgatgcgaatccggaagtgtacagcgccgaagatattgaaaaccatcaaaaacgattcctgcttctgctggaatccgctgtgaaagaccagacacaaaaaatcggcacactcaaccttctgcctgaaagtgaacgtctctgcgtactggaaagctggaatgacacgcgcaaggccgagaagcagaaaagtctgccggagctgttttacgaacaggccgtaaaaacaccggaccggccggcaatcatcaccgaaaacgaagagctcagctatgccgaattgaacaagcgcgcgaaccagcttgccggcatgctaaaggaaaaggggctcggaccggaacaatttgccgctttgctgcttccgcggtcacaggagttggccgtgagcatgctggccgttttgaaaacgggagccgcatacctgccgcttgatcctgattttccttctgagcggatcacatacatgctcaaagatgcacaccctgcatgcctgattacaacgatggaattatccggccgcatgccggaagacagtgatgcaaaaaggatcattctcgatgacccggatacggtaaaaaccgttgccgctcaaaatgctgactgttccgatcaggcggaatgttcgcctttgcaccccgcttatgtcatatatacatcgggttcaacgggcaaaccgaaaggcgtagtcgtgacattaaaaagcgtaagcaatttcctcttatccatgcgggaaatgttcccgctcggcgcacaagaccgcctgcttgccgttacgactgcggcgtttgatatttccggacttgagctcttccttccgctcatcagcggggcggggtgcgtcatcgcacgtaaagagacgattcaggaaccgcgggcgcttgcgaacatgattcactcatacggtatttcaatcatgcaggcaacgccgacattgtggcattcattagtcaccaatgaacctgattccctccgggcgctgcaggtgcttgtcggaggtgaggcgcttccgaacgcgcttatgcatgctctgcttgaatcaggctgtacggtgacgaatctgtacgggccgactgaaacaacaatctggtcggccgcacagccgcttgcaaaagaccatacaggggcgcctccgatcggaaagccgatttggaacacgcgggtatacgtgctggacgccgcattgcagccagtcccgccgggaattgcgggcgagctttatatagcgggcgaggggcttgccagaggttattataaccgtcctgatttaacagctgaaagatttattgccgatccgtacgggcccgcgggcgcgaggatgtaccggacgggagatctcgtgcgctggcgtgaggacggctcgcttgattatatcagcagagccgatcaccaaattaaaatccgcgggttccggatagaattaggagaaattgagtcagtgctgtcgaaatacccgggtatttcgcaggccgctgttattgtccgtgaagaccagccgggagataagcgcctggcggcttatgctgtcgcggatcagccccttgatatcggcggacttcgtgaatatatgggcgaaagcctgccggattatatggtgccgggcgcgtttgtacagctgaaagaattgccgctgacgccgaataagaagctcgatcgcagcgctctgcctgcacctgatttttcagctgtcctgtctgacagagggccgcggacgccgcaggaagaaatattatgcgatctgtttgccgaggttctcggtctcgcgcgggtcggaattgatgacgggttctttgaattgggcggacattcgctcttagccggacgcctgatgagccggatccgggagacgatgggcgcagagcttggcatcggacgtctgtttgataccccgaccgttgccgggctcgccgcacagcttgacaccgcaaagagtgcgcggcctaagctcaagccgtttgaccggccggagcacatcccgctgtcatttgcgcagctgcgtctttggtttctctactgtcttgaagggccgagcccgacttacaacattccggtgattgtccgcatgtcaggcaagcttgaccaatcagcgctgaaacacgccttttacgatgttgtcagccgtcatgaaagcctgcgcaccgtttttccggaaaataagggatcatctcatcagcttattttacctgctgaagaagcccgccctgtgtttacagtgacacgtgcagacaaaaacgagctccaagacatgcttgccgctgcggcaagatatcggtttgatctcgctaaagagccggccgtccgggctgagctgtttgatcttggtgacggcgaatatacgctgatggttctcctgcatcacatcgcaggcgacggctggtccttgaatccgctcatgcgtgacttatccatagcctatatcgcccggcaaacaggtgaaaaagcagaatgggcgccgctggcggttcaatatgcggattatgcgctttggcagcagcagcttttaggcagcgcgtctgattctgagagcttaattgcgcgccagctggatttctggaagaaaacgcttgaaaatgtaccggatcagctggagctgccgtctgattttccgcgtcccgctgaatcaagctacaggggcggcgtcattccggtcaacatcggccaagagcttcatgcccgtcttctctcacttgccagaaatcagcgcgtaagcctgtttatggtgcttcaatcagggctttccgcactgctgacccggctcggggcgggaaccgatattccgatcggcagtccgatagccggccgcagtgatgacgcattaggagaccttgtgggtatgttcattaatacactcgtactgagaaccgatacctctggcgatccgagcttttgtgagcttcttgaaagggtcagggaaatgaatctcgcagcatatgaacatcaggacgtgccgtttgaacgtctcgtggaagaattgaatccggttcgctcccggtcaagacatccgctgttccaagtgatgctcgcattccaaaatacgcctgaccctgtactcagtcttcctgatatggaaacaagcctgcaaatcagcagtgtcggatcgtccaaatttgatttgacattggaattggctgaacagcgccatgatgacggcacgcctgccggtattgaaggcctgctggagttcagtacggacttattcagaaaagaaacggctgaagcacttgccggacgcctgcttcttctgctcgaagatgccgtatcacatccggataaaccgatcggaagcttaaccattctttctgatgaagagcgccggaagcttttgccggttaaacgggcaaaacagcatattcagcctcggcagacactgcctgaactgtttgaaatacaggccgccgcaaaatcggatgaaacggcggcagtatttgaagagagcggactcacttatcaagagctgaataaaagagccaatcagctcgcgcacatgatgattgcccgcggcgtcggcccggagcagtttgtcgcactggcgctgccgcgttctttagatatgattgtcgggctgttagccgtcctgaagacgggggcagcgtatttgccgcttgatcctgattatcccgcggaccgcatcgcttttatgttacatgatgccaagcctgtatttatgctcaccaaccgtgaaggcgcaagtaagctctctggcgaaaacggcatgccggccttcatcctggatgatccgcagaataaggaaacacttcggcaatatgccgtcacgaaccctgagaatgccgaccggattcgtccgctgagaccgcttcacccggcctatgtcatttacacgtcgggatcaacaggtgtgccgaaaggtgtcatcattccgcacagcaatgttatccggctgtttgagtcgacgcggcattggtatcactttaattctgatgatgtatggacgatgtttcactcctacgcttttgatttctctgtctgggaaatatgggggccgctgctccacggcggacgtctcgtcgtcgtgccgcatgacatcagcagatccccggaagcgtttctgcatcttctcgtgaaagagcgagtgaccgtacttaaccaaacgccgtcagcgttttaccagctgatgcatgcggaaaaagaacacaaagagctggggcatcagctcgcactcagatatatcatcttcggcggcgaggcgcttgagctgagccggcttgaggattggtacagccgccacgcggacaatcagccggtgctcgtgaatatgtacggcattacggaaacgacggtgcacgtcagttaccttgaattagacaaaaacattgccgaactgagagcaaacagcctcatcggctgcggcattcctgatctgaacgtatatgtgcttgatgaccggctggagcctgtgcctccggggatcacgggcgaaatgtatgttgccggagggggcgtggcacgaggctacttagggcggcaaagcctgaccgccgaacgctttgtggctgatccgtacggcccgccgggaacgagaatgtaccggacgggggatttagcccgcctgcggacggacggttctcttgattatatgggcagggcggaccaccagattaaaatccgcggcttccggattgaattgggggaaatcgaagcggttctcgtcaaacatccggatgtcgaggatgccgccgcagtcgtccgtgaagaccggccgggagataaacggctggccgcctaccttgtccgatctgccggcagcaccttggacacgggggacatgcgccggtttgccgaagaaagcctgccggattacatgattccatcagcttttgtccaaatgaatgaactgccgctgacaccgaatggaaagcttgaccgaaaagcgctccctgcgcctgacttccaaacggaggtcaccggccggggaccgagaacgccgcaggaagaaatgctgtgtgagctgttcgcagaggtgcttcatctgccgcgtgtcggtattgatgacagattttttgatttaggcggccattctttgcttgcggttcatttaatgagccgtattcgggaagcgatgggagccgagctcagtatcggaacactatttgaagctcctacggtggcaagccttgctgaaagacttgagtcaggaacgggcacaagcgcgcttgatgttcttcttccgctcagaacggcaggagaagaaacaccgttgttctgtgtccatccggccggcggtctcagctggtgttatgccgggctgatgtcttctttagaagctgattatccgatatacggcttacaggcgagaggcatcggaaaaaaagaaccgcttccgcaaagcttagatgacatggcggctgattatattgaaaaaatccgcaccgtgcagccgaaagggccgtaccgtctgctcggctggtctctcggagggaatgtcattcaggccatggcgacacaattacagagccggggcgaagaggtttcgcttttggtgatgcttgacgcgtatccgaatcattttctgccgataaaaaatgcgcctgatgacgaggaagccgtcattgcgctgcttgccctgggagggtacgacccggacagcctcggggatcagccgcttgattttgacaccgcgctgaccattctccgccgtgagggaagcgcattagccagcctggacgagtcagtgatgatgaatctgaaagacacgtacgtaaattctgtcgggctgttaggaacatacaagccaaagccgttccacggagatgtgctgttcttcagatccacgattattccggagtggtttgacccgatcgagccggatacttggaaaccgtatattactgggaaaatcgagcggtatgacttagactgccgccataaagatatgtgccagccgggcccgcttgccgacatcggcgcgattctggcagagaaattaaacggacggcgtacagtccggtaaagaaaggaaagagatgatatgacaaatccatttgaacgggaagacggttcataccatgtgctcgtcaatgctgaaggccagtactcactgtggccggcctatctggatgtgccggacggctgggaaacccgcctgacgaatgaaacccgccccgtttgtctcgaatatattgaaacaaactggcgtgatatgaggccggaaagcctgaagcggaccgaagctgctaaaatgtaataagaaaagcctgccgttatttcggcaggctttttatgcggacatcagccgttaagctgtgtatgatcacaaaatgtataagggtggccttcttcatccgtgcaccatgactgagacagaaaagccaaaaagaccgcggcccactggtctgcaaactggattaaaataccgccgtcgtgccacgttccgttatccttcttccagcgtgtatcaattgggtttccctgattcatatgaatattatgcatgccgtttgtcggcttgaacccgaaaatcttatcagcgcccggctccggcccgaatttagagccgtaaatatagacggtggctttttctgatttggctttttgcatgtacgtctcaataaagtcatttaagtcattatccggaccggtgacttcatgcggaaggggcaccatgttccggggatcaaacaatccgccgcggacataatccagcgccagctcacgtctggtttcatcaattggggtatatccgtacggaatgttcggcagcagggtgatcgcgcttgcgtcaaaatgatcgcgtgccgcatacagcacctctgattcttttgaacttgacatgacattgatcgcacagcgatagcgcgtatcaggctcgcctagcacctcgacttgaaaatgcggagaatcatcatctgtttcccttttcatatctaacacagtgccttttaatacaccatagtgctgaacagccatatgaatcctcctttttcttccgggatatgaattgatattcgagacagggggccgtttttccttttgtgagaaagaaaaaaggacagcccgctgatcaggctgtcctcttcatctctattaagcttttgcagccgaaccttgcattgctttttcagcaggcacgtagtcatagcctaagtctttggctaccgcttcatacgtgacatgtccgttagccgtatttaagcccgctttaagcgcagggctgtctgcaatggcttgtgccgcgcctttattggcgatttgaagcgcgtaaggaacggttacattcgttaatgcgagcgtagacgtacgcggtacggcgcccggcatattggcgacagcgtagtgaacgacgccgtgtttttcgtaagtcggattatcgtgggttgtaatatgatcaacggtttccacaatgccgccctgatcgatggcaacatcaacaatgacggaacccggtttcatttgtttaaccatttcttccgtaacgagagtcggcgctttggctcccgggatgagcacggcgcagatcagaagatccgcttccgcgacggaatctgcaatatttacagggtttgacatcaatgttttaatctgatgcccgaaaatatcatcaagctgacgcaggcggtctgcgttcaaatcgatcattgtcacatcggcaccgagtccgacagccattttcgcggcatttgttccgacgccgccccctccgatgatcgtgacttttccgcgggatacacccggtacgccggctaataaaattccttttccgccctttggtttttcaagaaactgtgccccgatctgcgcggccattctgccggccacttcggacatcggcgtaagcagcggaagggaacgtccgtccgttaccgtttcgtacgcgatagctgtcacacctttttctgtaagcgctttagctaattccggctctgcggctaaatgaaggtaagtgaacaagaccagaccttgacggaaatacgcatactcttcagccagcggttcttttaccttcatgaccatttccgcatcccatacttgctttctgtcctccagaatttccgcccctgctgatacataatcttcatttgtaaagccgcttccgagtcccgctccggattccacaagaacccgatggccgtttccgataagctgtgaaacgcctccaggtgttaatgccactcgattttcattgtttttgatttcttttggaaccccgataatcatgtctgtttcccccaatgtttgtgtgatgcttcaagtgtagcgcgatttttgcgaaaattctttgtttgaaacagaaaataaaaaaacacggatttgtgaaatttcacgaacccatgctgcgaagtttgatatccaggtaaatcgtaaacttctcattcacattttttaagtcgatttctgcgatctggctgattcttttcagcctgtaattcaatgtattgacatggatgttaagcgctttagcggcggtgttgacattgctgtcggcatcaataaaatgttcgagcgtttttaccatatcggcttggtgctccctgtcatactgctcaagctttgacagggaatagttcatatagccgctgtgcttgcgtttttcatccaacacatcaaggtactgataaatgccgagttcagaaaagctgaaaaggtgtttggtttctctcacaaaccgctctttcgcttttaatacggaaagcgcttcctgataggatcggtaaacgtaagaaatcgattcgtaaataccgccgatcgcaatcgacgcatcctcaattttatatcgttccttcaactgtttttgaatatgaagagcgaagtgctttaaatctttaaaaggctgatcggttttcggcgcggctaataagattaattcatttgaatcaacagtcgccagcatgacatgaatctgctgtgtcgtttcctgcaaatattgcagctgctgttccgtcttttcagtcagctcatcatgtaaacggatgatcatgacgctgaacacggacggcagcgccattccgagcttatgaaacccttcggccatctcggcttcctgataaatatggccggtcagcattttccaaaaaaactcctggccccgctcttcgattttcgttttgcggatctgcaggtgcaaaagcttgttccgcaccgctttggctgccagctgaagtgtcttcagatcttcgtcattgagcttttttttgatctcaagcgcccaaataaatccgagaacctgactgtttttccagatggaaatcgccacgcggttgcttaggcccacctcgtcaatttctttcactttgatcggctggtccgtttttaaaagggccggaatggttccgtctttccacagtttgttgatgactttttccggcaccctccgcccgataatcgtcgacgtccgggcaggatctgtacaatcgctgtgcgtgctgtatgcaagcagtttatgattaacgtcttctattgtaatggggcattgaagaacttcactgatatggtcggcaacatcttcaagcctgtcgaaactgtacttaaatggatcttttggattggtcatctgtatccctactttttcatagcttcatatcttgatcttaccatcttgcttttcagactgaaaggcatctttgcagggaaatagactaggacaataagatcattcagtgaaaacgaaaataataagaaaatcatactattttatttacaaaatgtgtaattatgacgaaaaatccaatatatcataagactcattttgtaaaattaaaacagatttgtttgactgtgccgattggttgtttttataataatgacgttcaaaaaataagtgaattagcccatatttaggctgatgacacaggagggtataaggaatatgtctggattaattcgtgtcacacccgaagagctaagagcgatggctaagcaatatggcgttgaaagtcaggaagtcatgaatcaggttgaccgcctgaaccgcatgatttctgatttgaaaggcatgtgggaaggtgcttcaagtgaagcattcgcggatcaatatgagcagctgaaaccttcatttattaaaatgtctgaattgcttcaagatgtgaatcatcagctcgatcaaacggcaaatacgcttgagtctaccgaccaagatatcgctaaccaaattcgcggataataagatgaatgaagaaacggagcgcctgattcaatcaagaagacggcgctctttctatgtaagggtgatatgaatatgtatatcgatattacaatagatttaacacattataacggcagcgtcttcgatctcagattgtcagattaccattctgtgaaaaaagtcattgatattgcccggcaggctcagcatgtatccgttccgccgcgtgaaggctattggatcagagtggtcaataaagaaacggttttttccggagaacaaaagctatctgactgcggcattacgaacggagaccgccttgaaattttatgaaaggacatggtggaatgacaggtcataacagatcttatttagaaacagaattagacgccgtccgggaagaaaccgaatcaggcttcacgttcaccttccagcgggaaaaaatcaagcttcttgacgggctggaagcgaatgtgattaaagatgccgatcctttttttcaaaaagaggtctcagtttcagaagacgaagtaaccatcacaatcaaacctccttcttcttatcaggctttccgctatataaaaggaaaagataaaaaaagcaggtggcaatttgcctaccgtctcgtccaagccgtgaaacagcataagctgaaacgtctcaatctgattgccgcccctgaaaatatcgtgtttgataaagcgctgacgccttactttcttcattacggcgtaaaggagagccttccgccttatgaggaagatagagaaagggtgttaaaagagctcaaagcctgtgcggcgcttgcagctgacggggcgtacaccttcgatgaatatttgaagtacaaggagacgcttcatttctctcctgaggtgaaaagcgtgttagaggcggagacgattgaagaactggaagaagccattcaaaccgcaatcgattccctcgaagaaagggacaagacatacataaaactgccgaaaaagaaatggaaaatccaaagatacgccggtctggcgcttgccgtcctccttgtgccggcacttctttactccttatacgttctgtttttcgtccagccgaagcaagaggcaattacggaaagcaaccgctattttttaaatcagcagtacagcaaagtcattgacacactcgctaaatacgatgcggaaagcctcccggaatctgtgcagtacgagcttgcttcctcttatgtggcagttgaaaatctgagggaagaacagcggaaaaacatcgggaatctggtcacgctgcaatcagacccgaagcacttcctttattggattgatatcggcagaggggaaaatgaagaagccatcaaaatcggccgcaatcttgagtacaacccgtacatctggctcggacttacaaaatataaacagcaattattagcggatgacagtatgaaagacgacgaaaagcagaaagaactggacgccgtggaaagcgagcttgcgaaggcgaaaaaagaggcggaggaacagcataaagaagcggaggaaaacagtgacaccgccgaagcttccgccggacaagatgaaagcaaacaagacaaagcgaaagataacaaagagaacgacaagaaagatgagaaaaaagatgaaaaaaaataacagcacacatcaaatggccgcatgtaacgatcaggctgtcgtcaggaggttcgccatatgagtctgttatgggtcttttaccgagagcacgtacaaaaggttcagctgtctgaactcccgccctctcagccgattacgatcggtccggatatgaaagatacaatcacggtcggcacacttccgttacggcaaaacgccgcaaccctttatcggaaagaaacagatcgttatgatgttttcctgggaaataactgtgccggcgaattgacaataggaaatgaaatgccctgccggattgaagaagagacgatgcggcttctgctcacccctgaccaggaagaatcctccgtgtactttatcggcgggaaggatgagatcgttttctcatcagaaacagaggaagcggatatatacaaagagccgtcctccgctcaaacaggggctttttatctgcgtaagtcgggaggatgctggtctgtcgtccctgatggtcaggaagtttatgtgaacggaaagcttgcagaagctcccgaaaggctccggacgggagatgagctgctgtggaattttctgcgtgtgaggctgacggaggacgaccttttagaaatcgttcatcacgaaaagcttcaagccggtttaaccaaaacggtaaaaccaagcaccgaaatgaaaaagaaatacccgcaatatcgaagaacgccgcgcatggtctacgatcttcccgaagaccgcgtttcattcagctttccctcgcaggaaagcgaacagaataaccgggggctgtggctcgtcattctgcctcctgtggtcatgctgattgtaatgggggttgtcgctattatacagccgaggggcatattcatccttgtctctttggcgatgtttatgatgactctcattacgtccaccgtgcagtatttccgtgaaaaaaccagcggaaaaaacgggaggaaaaacgggagcgtgtgtacaagcagtatttagaaagcaaacggaaagagcttcagacgctgtcggaaaaacagctgcacgtgctgacgcatcattttcccccgtttgaaaaaatgaaatatttaacttctgaaatcagcggccgcatttgggagaaatcgctggaaagcagggattttctgatgcttcggctcggaacgggcacggtcccgtcaagctacgagatttcaatgagcggcggagacctggcgaaccgtgatgtggatgacttgatggagcagtcgcagcacatgcagcgtgtgtataaagacatccgccatgcgcccgtgaccgttgatttacaagaagggccgatggggcttgtcgggaaacctcagatcgtcaaaaatgaaattcaccagctgatcggccagctcgcgttcttcaacagctaccatgacctgcgatttgtctttatctttcatgaggacgaatataaggaatgggaatggatgaagtggctgccgcaatttcagctgcctcatatgtatgcgaaaggatttatttacaatgaacagacccgcgatcaattgttatcgtccatttacgagctgctgcgggagcgggatttggaagaggataaagaaaaaaagatctttcagccgcattttgtctttgtcatcacaaatcagcagctgatcgcagagcacgtcattttagaatacatcgaaggccggcatgagcatctcggcatctcggccatcattgccgcggaaacaaaggaaagcctggcagaaaacattcacaccctcgtccgctacattaatgaagatgagggagacattctcattcaacagaaaaaagcggtgcagatcccgtttaagctggacaggcatgaacggacaaacaacgagcggttttcccggacgcttcggacattgcaccatcaggtcggaatgacgaattccattcctgaaacggtctcatttctcgagctgtttcatgcgaaggaagtaaaagaaatcggcatcaggcagaagtgggagacaagtgagtctgcaaaatcgctggctgttccgatcggctataaaggaaaagacgacatcgtctatttaaacctgcatgaaaaagcgcacgggccgcacggattgctggcgggaacgaccggctccgggaaaagtgaatttctgcaaacatatatcctgtcattggccgttcactttcacccgcatgaagcggcgtttttgctgattgactataagggcggaggaatggcgcagccgttccgcaaaatgccgcaccttctcgggaccatcacgaatattgaaggaagcagaaacttcagtatcagggcgcttgcatccattaagagcgagctgaaaaaacggcagcggctgtttgatcaatatcgcgtcaatcacatcaatgactatacaaaactgtataaacagggagaaacggatattccgatgccgcacctgtttttgatttcagatgaattcgccgagctgaaaagcgaagagcctgactttatcagggagcttgtcagcgcggcccgcatcggacggagccttggtgtgcatttaattctcgccacgcaaaagccgggcggcatcattgacgaccaaatatggagcaactcacgctttaaggtcgcgctgaaagtgcaggatgcaagtgacagtaaagaaatcctgaaaaacagtgatgcggcgaatattacggtcaccggacgcggctacttgcaagtcggaaataacgaagtgtatgagcagtttcagtctgcctggagcggcgccccttacatggaagatgtatacggcaccgaggatgacattgccatcgttaccgataccggcttaattccgctgtctgaggtggatgcggatgatgcggcgaaaaaagacgccccggcagaaatagaagccgtagtcgaagaaatcgagcggattcaaaatgaaatgggcattgaaaagctgccgagcccgtggcttccgccgcttgccgaacgtatcccgcgcacgctttaccccgcgcaggaaaaagaccgcttcttcatcgcctgcgttgatgagcctgatcagcaaagacaggcgcctctcgcttacacaatgatggatgacggcaacatcggcattttcggctcatccggctacggcaagtcagtggctgccatcaccttcctgatgaatttcgcggaaggatacacgccggaagagcttcatatgtacatctttgacttcggaaacggcacgcttctgccattggcaaagcttccgcacaccgcagactatttcttaatggatcaaatgagaaagatcgaaaaattcatgatccgcatcaaggaagaaatcgagcggcggaaacggctgttcagggaaaaagaagtcagccatatcaaaatgtacaattcgctcagtgaagaagagctgccgtttatatttatcacaattgacaatttcgacatcgtcaaagacgaaatgcatgaattagaaacggaatttatccagatttcacgcgacgggcaaagcttaggcatttacttcctgctgaccgcaacgagggtaaacgccgtccgccagtcgctgttaaacaacataaaaacgaaagtcgtccattatttaatggatcagtcagaaggatactccatttacgggcgtccgccgttcagtctcgaaccgatcccgggccgcgtcatgatccaaaaagaagaactgtatttcgcgcaaatgtttcttccggctgaagcggaaaatgacctcgagatgttccaggcgctgaaagctgatgtcaaagctttagctgagcgccacgccggaacagccggaccagacccgattccgatgcttccggatatgctgacggccggcgaattttcactccgtctcggcccggaacaagacccgttccgcattcctgtcgggcttcatgaggaaaaggtcagccctgtgtactttgatctgggtaaaaataagcattgtcttattttgggccagacacagcgtggaaaaacaaatatcctgaaagtgatgctgaatcacctgctgcgtgaaggtgcggaacgggtcgggctgtttgactcgattgaccgcggactgtcgcagtatgcgcaggaaacaaaggtcagctatctggacacaaaagaagacgtccggcagtggatcgaaacggcagaagccattttcacggagcgcgaagctcagtatacgcaggccgtcaaaaatggcgatgtgcacaaactcagtttctctccggtcgtgttaatggccgacggcattacaagattccagcagacgatcgacaccgccttacaggacaagctggcgatgtttatgaaatcttacgcgcatgtgggcttcagttttatcccggcgggcaatcacagcgaattctcaaaaggctatgattccttaacgacggaaatgaaacagatccgccacgcgatgctgcttgtgaaaaaatccgaacaaaatgtcattccgctgccttaccaaaggcaggaaccggacattcagccgggcttcggctatttggttgaaaacgggaaggagcaaaaaatccaaatacctttatgttcagcggaaagggaggccgtcagatgaccgaacaacgaaaaagcctgatcaaattaatagccgcggtcgtcatcattctgctgctgccggtgctgtttttccggtttatcggcgatgacccgggaaaacaaaaaatcaacgccacccgccaaatcgcagtcgtgaatgaagatatgggcttacaaacagatgaaaatgaggaagaggaatccgtccatttcggcaaagaagtagcggccgctctcggcggccgtccggattattcatggacggttgtcaacaggagcgcggcagaaaacggtctggcggctaagaaatatgacgccgtcgtttacattccatccgatttttcaaaagacatcttaagctatgacaaggagcgtccgcaaaaagccacgctgacattcaatattcaaagcaacctgaacgccgtcaacaaagaaaaagtgcagcgtgagcttgaagacgcccaaaaatcaatgaataaaaaaatgtcggcattatattggaatttcgtctcacaaaaagtgaacaatgtccgaggcgattttgacaagatcgtcaataaagaatcagagtttcaaaatgtcatgtacaacttttacaagccgagctccaatgacttggcaggtgaaatcaaacggcaaaaagacctgattgacgaactgaaaaaatcaatgaatgaagcgcagggcgcggcaaaagaaaaactgacttcggcagatgaagccaaaaccacgctcaaagactttgccgacacggtcgagcgctacaaacaatatcaagaaaatcagaaaaaactgctgatggccgcgcaggaacaaaatcaaaagcaaatcacaaccggactgaacgccattaaagcacagcaggccgccaaccagttcagcacgatgatgagcgggctctcttcaggcataaaccgggcgcagacacagcttgaccagacgggatcggctctttttgccgcccaacaggtgagagaagcgcaggttcctgatcaggaacgcgggatggcgaatattcaatccaatttactggacaattatttgactcaatataaagcgcaagcaagatttgaaacattgaacagcattcaaacccttatgaaaagggatcggccggcattaaccgttccggaaaaggacccgggtgatgacggctcggatgaaccgaaagaagaagaaaaaccggaagaagaaaaacccggcgatctgaaaattgaccttgacgatcagcgtgacgaattaaaacgcatctccgctgaaatcaatcacatttctgacggattaaaagaaccggaaaaagaaaaaccggaaccggaagaaccgggccaaggcgatgacggtgaaaactccggcgataccgatccgaataacggaacggctcccggagaagacggaaaaacggaagacggcacaaaagaagagcagcctgcctccgataacacaggcgatcaggagccaaaaaccgtccagacctcgacagccgctgaaaacgtcactccgcctgctgatgagccggcggacgatccaaacgattctgaaagggacggcggcacggacatatctgaggcaaaagaaaggctgaaccaagccgcagaacgcattcagcaaattgaaaaagagctggaagagaaacagcagactcataataaagaactgaaaaaacgtctcgatgctcttgatgaagaaatccaaggccttaaaaatcagattgccaaagttgaaaaacgggcagataaattaaaggaaaatttggaagaattggaagaaacgagaaaacaagacttcgataccgtttacagaatgattgtaagaacagaacagaacattctgaactacccgtcattggatagcggccgcaaatctgctcttgaacagatgtttgccgctgacatcaatacaaaaaagatatccgatttaatgagttactataatgatttatccctgtatgaggcgacactctatcactctcttgacgcgggctcgctgcctgatgtgaaaaaccgggtgctgaaagcccagcaaggtgaagtccaaaccgttcttgccatcaaaccggaagaaacggcaagctgggaaaatctgaaaaacaacaaaatgcagactgatgaagacatcagcaatttcattaaaggcatgaccgaattctcggataactacagctcgtatatcagagatgagcaagccggggtgctcgatgagcttgccagcatttcagacagcgcggcgaaagcatccgatcagctggctgaaggcgctgtgcaggaagcggccgcgttcagcggagacggattaaccggaacgatggcgctcggcgctcaggataccgtcggccgtgaagtcctgcaaatgtctgacacgatgggccatctgtcagaacgccagtccggcatcatcagctataccgacaatatgcagcaaagcgtaaatgacgtccagcaaaaagcggacaccctgaacagcaactggggcaaaaacgtcgattccacgaaattgatcagaaatgacgtgtacggcattttagggaacgcgctcgttgacggacaggaaaacggatatgtttatgattatctcgccaatccgcttaaaatcagcggagaggtgccggaagaccgggttcagaatgttccgccggtcgtcattttggtgatcgtcctgatcagcagtcttctgatcggctatttcagctcgtattatcagcaggcgccgcttcttgtcaaaggcgcgctctttgggattttaaacattatggtcggattgatgatcagtctgttcggtctgaatatctattcgcttccggatgatcagacgattaaatggtcagtctttacgattctcctgcttgcggcgagttcagcttttatccgggcagcctttgtcttcagctcaattaccggatggatcgcatcatcagcgctcattctcttttatgtggcgcctttgatcgacctgattatgccgaacttcacctttgacagtccggtttcgaaagtctatatcgatattcaatacggaacgggccatctgtttgcgttgggggtaacggttcttgcgatcattacgctgattgcggcggcgcttccgctcgtcattcggctgtttgcggaaaaaacggaggaaagtgatcagtcttatgaggcgtaacacgttcatggaaaaaggattgctgctgtttgctctctcctttttccttttccttccccaagccgcagccgcgaatgaggaaaatactgatgtcaagccgaatgaatatgaaaagaaagacattgaaattcgtacggactacctgcacgacgatgcctactccgaggaaaaaacggcgcttccgaaagaacagaaggatatcacgtttgatcagccggccgaaaacccggatgacaaactgatatcaaatttgtttacatcgtcagacacggagccgaatacgatcaaagcgcaatcgaaacaactgggtatcacatttgccgagccggcggtgcggcatacctcggcagatatggaaacggaagagaaaaagacttcttatctgcttcccgctatttatgccgtcttgatcctcctcgggattgcggcaatgatctatctgatcccgaaagtcacggcgcaggaaaaggcaaagcggtaaaacggatcgcttgtgtttgcgggaagacagcccgtaaaataagaaaaaaaggaggagtttcatgcagttttttcttataacaggcgcgtcaaaaggcttgggccgggcgcttacggaacaggcgcttcaagaaggagccgaagtcgccgcgctttcaagaacgataagcggggaaaagcgcgaggggctgacagaatacagtgttgatttaaccgatctcgcagataccgggcggcagatgaaggcgattcttgatcaagcagaggagaaggggtactccgccgtcacactgatcaacaatgccggaatggtggaaccgatcaagcgggcgaaagaggcttccgccgaagaattgaaccgccattacacccttaacctgacggcgcccgttttgctcagccaaatgttcacaaagcgcttcgaagcgttcagcggcagcaaaacaattgtcaacatcacatcgggcgcggcgaaaaatccttataaaggctggagcgcgtattgcagctcaaaagcggggcttgatatgtttacgagaacattcgggtttgaacaggaagatgaagagctgccggtccgcatgatatcattctcgccgggagtgatggatacagacatgcagtcggtcatccgttcttcgtcaaaagaagatttccatgacatcgaacggttccgcaatctgaaagaaacgaaaaacctcagaagtcctgaatacatcgccggcgtcattcactcactgatcgcgggcgagccggaaaacggacggatatacgatatcaaagaatttttgtagagcagctttcacgctgctctttttttgtttgtacaatcacttaggggtccggcggcatatgatgaatgaaacaacatataaggggtataagaaatgtatcagatgaattgagtttcttctcgatttatgttaggattctaaaaatatatgaaggaggggtttccatgagaaatgtaacgttaatggatgtcttcacccatccaatcgcacaaaagtatttacagcgttccggtgtcgcccatgcgatcgcctgcgcgtttcatgcataccgtcttgccgtaaaagcaggtgtcagcccggatctggcggcgaaagcggcattactgcatgacgtcggccattatgaatggtacacagacggcaaatgggattatgaaaagtacagaagaaatgatatccatgccattaaaggcgcggaacgggcgcataagctgctcatccggctcggtgaagaaccgaaagcggcgaaggacattgcgctggcgattctgcttcacaccgattcctatctgcctgaaggcgaactggacaagaatacgctccagcaaatcgtgaaacaagcggatgaactcgatgaagaacccggcggacatcaccattaccgccaaatggatcacacggccgcgctcaaacaaatccaaaagcttgatcagttaattgaccgagcccaatatcccataagaagctcagtctaggccactcatgcggccttttccgcttacataactccgcatgctcactaacaccttttccgctccgatagacgtactgtgtcaaagcctttgtccgctgcatatgctgaaggaaaacatagtaaaggggatcagcgaaaatggcccatcaaggaagcccgcaaatcgtctcgttagtggatccttacgtttatcagaccatccataagcttatcggctcaaggtttatcattcaaaccgtcagacgcattgtcagaggacggctgattgatgccactccggatcacatcgccattgaagagacgcatgaccgtgtattttatatcagaaaccgccatgtggtttccgtcatgcctgattataccgaacgcgtgtaacagcccgaaaaggcgcaaaccggaggcggcactatagaaccccggtgcgtcttcttttttgagatacatagatgcacggcggctttttttggtacaatcacagtacaagttcacacgacaataggaggaaaccgcttgttgaaatcaaaggtccatttttggacgctgcaaattttgctcgttttgctcattatttacgtatcaacgaaagtctcgtttatatttcagccgtttttcggttttatcaccactctgttttttccgattttgatctcgggcattttgtttttcatttttaatccgatcgtgcgcctgcttgagaaaaaaatcccccggacattggcgatcctgctcatttatctcgttttcatcggtctgattgcctttatgttcactgccatcgggccgattgtggcttcccaggtcacggggctgattaacaatttccctgattacattcatcagattcaagtcttgacggcgcaattatcccattccaaatggtttacgtggatgatgacgcaggattatgtgtcgatagaaaaaatccagcagtctctgacgggatttttacaaagccttccgcaaaatattacggcaagcctgtcggccgtgttcggcgtcgttacgaatatcacgcttgtcgtgatcaccgttccgttcattttgttttatatgctgaaggacggccggcggtttccgctcttggcggtcaaaattctgccttcttcctaccgggcggaaggtcggaaaatatttaacgacttatatgtcacattggccgcctatttccaaggccagctgctgatttgtctctttgtcggaacggcatgttttatcggatattggatcatcggcctgccgtatgcgttaattctcgggatggtgatcgccgtcaccaatatcattccgtacctggggccgtttctcggggcggcgcccgcggtgattattgcgtttatggattcgccggctaaggcgctgtttgccgttattgttgtcgttgtcgtccagcagcttgacgggaacctgctttctccgcttgtgattggaaaacggctgaatacccacccgctcaccattattcttctgcttatcggagcgggcagtttcggcggcattctcgcaatgatcctggccgtgccggtttacgcggttttaaaagctttcgtcttaaatatcgtccggcttatcaaacttcgtcagcggtcaaagctcgaagacagccgcaagccgaaataaaaacgggcacaactcccggtgcagcgcataaaatgctgtaaagaaaagcggaggtgtgggtatgcctgcaattgtgggaccgatttatattatgagtttagccggagacgctgcagcgagcttcggtgacgtgtttgccatttctcccaaagccgttgaccactcaggcgcgggggcaggggcgtttcattccggagattttgtcaaaattactaataaattcagcaaaacgcgctttgaagacattgatgtgtttgacgaacctgattggtttaacgcgtgacagcctccttttaggaggctgtcgcttttttgtagtataatagaatcagtctttataaaaggggaatgttttatgaaaatcagaaaagcgaatattaccgtgcagtccggaatgatcggtgatgtatatctgcatgaaaataaaaaagaacagcatacccttgtagccgttccggaacttgagtggagcacgatcatttcctatgaggaagagaaaaaggcgctggcgcagcggcttttacaatcattcagcaagctgattgaagaagaacccgccggagagctcgccggcaagatctcccattgggtggctgaaatgtaacgaaaacggtttaccgcgtcccgtccggggcgataattgtaaaacaagctgggagggacaggccgatgagcgacaaaacggttgacctttatttacagcaggggatgtacggccctttgcagacgaaaccggatgaacgccatttatttttaggctcgctgcgtgaaagagtcatcattgccctgacgaagggacaggtgctgcaaaagcagccgtatgaagaagtgaaacaggcgctgaaaagccgaaaagacgcggtgctctatataaacggaaggctcccgtatcatgcttattcaccatatatgaagcttgccgcacttgccggtgtccgaagctccgtcatctcggaccttcaattcgaaacgccgctcggcctggtttttgccgccgattatgccgtgaaccttgacggcatttacgtgcaggatgacatttttcagcgctcactcctgaaatcttaaaagggcaaaacactgtttgtcattttacaatgccaattcacttacaagtggagataggatataatggttttcatatgaatggcggggaggccggctatgaaaaaagcatttatatgcattgattatacgaatgattttgcagctgagaacggggcattaacctgcggagaacccgcgagacagattgaagatacgattgtcagtttgacgcaagcatttatagaaaacggtgattacgttgtctttgcggtagattcgcatgatgcagacgatgactttcatcccgagacacgcctgtttcctccgcataatatcaacggcacggagggcaaagagctgtacggaaggctatcgcctctttatgagaaacataaacacgcaaaaaacgtaaattatatggaaaaaacgagatattctgcttttgcgggaacggatttagagctgaaactgcgggaacggcagatcactgagctgcatcttgcgggcctgtgcaccgacatctgcgttcttcacacggcggttgacgcctacaacaagggctttcagatcgtcattcatcaaaacgctgtggccagctttaatccggaagggcatgaatgggccctgtcccattttaagaacagcatcggagcgcaagtggcagagtaaggaaggggaaaacaattttggtggagcatggttttaaagacgacagtttgtctttacatacagacctttatcaaattaatatggccgaaacgtactggagagacggcattcatgagaaaaaagcgatttttgagctttttttcagaaagcttccctttgaaaacggctatgcggtatttgcgggcttagaaaaagcaatcgaatacttggagaacttcaaatttaccgacagcgatctgaattatttaaaaacggaattgcactatgctgatgatttcattgattatttacgggatctttcttttaccggatctctttacagcatgaaagaaggcgagctcgtttttaacaatgaaccgattatgcgggtcgaagcacccctgattgaagcgcagctgattgagacggctctgcttaacattgtgaattaccaaacattaatcgccacgaaagcggcccgcattaaaggcgttgtcggtgatgaagacgccctcgaattcggaacgcggcgcgcccatgaaatggatgcggccatgtggggagcgagagcggctttgatcggcggcttcagcgcgacgagtaatgtaagagccggaaagcgttttaatataccggtatccggcacgcacgctcatgcgctcgtacaagcgtaccgcgatgaatatacggcatttaagaaatatgcggagacccacaaagactgcgtatttctcgtagatacgtacgatacgatccgttcaggcatgccgaatgcgattaaagtcgcaaaggaattcggcgaccggatcaacttcatcggcatccgcctggacagcggggacttggcgtacctgtcaaaaaaagcgcgtgaaatgcttgatgaagcgggtttcacagacgcaaaggtcattgcttcaagcgatcttgatgagcacacgatattaaacctgaaatcccaaggagcgaaaatcgatacgtggggcatcggcacgaagctgattaccgcatacgatcagccggctctcggcgcggtttataagcttgtcgccattgaagaggacggcaaactgaccgacaccattaaaatttcgtcaaaccctgaaaaagtgacaacgccgggaagaaagagagtataccggattatcaacaagctgaatcaccactcggaaggtgattatatcgcgctttatgacgagcgggtaaatgatcagaaacgcttaaaaatgttccatcccgtccacacgttcgtcagcaaattcgtcactgacttctatgcgaaagacttgcatgagccgatctttgaaaacggcgttttatgctatgataatcccgaaattaccgacatccagcaatacgtgcaggataacctcaaacttctgtgggaggaatacaaacggatcagcaagccggaagaatatccggtcgatttaagcgaagactgctggagcaacaagatgcagcggattcatgaaatcaaaagcaagctgaaacgggaacttgaatagaaaacaaagcggcctttcctatctctggaaaggcttttttgttgtgataatatttttcacatttagacaaatttcgtcaagttatttgatatacttatgttcgaaggccgcatctaagggggtaaatgaatgaaggtgtttgttgcgagacagcctatcttcaacagaaacgaacaggttgttgcttatgaacttctttaccgggagagcgaagagaaccgttattcggccgcggatggagataaagctacgacggatctcattattaacagctttatcaacatcggaatcgaaaagctgactgaggggaaacgctgctttgtgaattttacagaaagcctgatgttttcagatctccctacctcctttgatcctgaccagcttattatcgaaattcttgaggacataccgatcactccggcgctcatctcaagatgcagacagctgaagaaattaggatatacattagcacttgatgatttttacgccatcaatccggaaaatgaagagttagtggaacagctgatgaaatatattgatattttaaaaatcgactttttgcaatcctcgcgtctggagcgcaaaaaaatcattcagacgtacagctgtaaaagtctgatttatttagcggagaaagtggagacgagaaaagattataaacaggcggccatagacggctttcacctgtttcaaggatattttttcagtgaaccgcgtgtcatcagcggaaatgatctgacgtttcattttcattcttactaccagcttttaagcgaattaaacaatgaccagcctaatatacagcgcgtgacggaatacatagagcgtgacgtcagcttatcgtatcagattctgcgttttttaaacggatcgcaaacaagactgaaaaaaaagatagacagcatccagcaggccatcatgatgctcgggctgaatgagattaagcgcttgatttacattctttcattcagagatttaacggcgaaaagccactcaagccaaaaagaaatcattaagatttccttaatcagggccaaactgtgcgaactgctggcgaaaagaaccggaaggccccagccctcttcttacatgctgatcggcatgttttcgctcatcgatacgcttctccacagggaactggaggatatcatcaaagaactgcctttaatcgatgaagtcggacaggcgctgctcggttatgaaaacgattattataagatgctcgcgctcgtcaaagccattgaatgcaacaactgggactgtgacgagtggggaaaagaactgaacaaagaagaagcgtatgaatgttacttacaggcgatcgaatggtgccggcagctgatcgattgagccgctttaagccgaccatctgagggcgatgataaaccggctttgctctctgatcagactgacacggatgccgtcgggattatacgtcacgtcaaagtcatttttgatgccggtctgcttaatgagccgcttgaccgctgcggtgtcagatgattgcgctgcggtgaggatgctgcgcgcaagctcttttgacgccgacagccgcgcaaggagcaggcgcgcatcctccagcatgcccgcagcttcttttgcggacgctgtcaaaatatctgcgtgaaccggggcactgggcgctggatgccggtatggcgcggcgaaaacagggcagcatggatacacataatgcatacggcggcctccttcctgagaaaacattcgttatacatgagtataggcggcgtgataatgagttatgacatgcaaaaagaccacaatgcgggggttgcggtcttttcggtgtttgtcggtggttatgcgacgctgtttgcccattctgttttgaaattgtgacggcagggactatagtccctgccggtttgtcggaaaaccgttgaaaaaacagcagaaccgccagattggtctgctttatcctaaacgtctgcctttgcggtagttatatagtcctgttcgctaaatgccctgttcgggactatggaattaccttggtttgcggtgtcacgcagatacttttacacatacttttcggtgaaaaatcccgcaaaaacgtttacactattagtaacagatcaaatacctaggactcgttcaccatacacaattcattgatctttcaaaaaaaggagtgtggaaacggtggaaaacaaattagaagaagtaaagcaattattattccgacttgaaaatgatatcagagaaacaaccgactcattacgaaacattaacaaaagcattgatcagctcgataaattctcatatgcaatgaaaatttcttaaaaagacttggaaacaagtcttttttttgtgcattttttatccatttcatggataaagtattatacgattgttaaaaaacgaaaaacctgctgtctttcatcacctgcatttagtaaaatagaatgggagggtgaagacaattattgagcaaatgtgtttagatgccgaaacgattaaagagaagatgaaggaaattgtggaggagaaaataaataatccacatttaaaagacacccttcagacttttataaatgaaaaaaatcattttgcttttggtgttcttgcatttaagcattatgtggctttcgatggtgagcattattcggatattacgttattagcttcaggaattgaattgttaattttagcttttgatatttttgacgatatagaggatgaagataacttggataaggaatggatgaagatagatcaatctatctctttaaatgcagccacttctctttattcaataagtcttcaagtgatttgtgagcttaaaacgaactccgattttccccggcttgctatgaaatatgctttaaatgcaatgcaaggtcagcataatgacctcgaaaatttccccgaaactgaagacgaatgtcttcaaatgattaaacaaaaatcaggctcgcttactgcaatgtcagctgtattaggaacaatgcttgcaaatggggagtttaacgaagaaattgagaattattcctataaaattggaattgttaaacagattgaaaatgattattatggtctttttaataaaaatcgtagtgatatcagaaagggaagaaaaacattaattctgttgtatctaaagcgaagatttaatgctgcttcagaaaaaatcttggatttaatgaatgcagaagcaagttaccattcattcctcattgataataaaaaaagccttgaagacctactatttgatgcaggagttagccagtatgtttcaatgttaattaaaatgtacgaggaagaaattacgacaagtataaaagatttaaatataatgttagaactttaatggaggaaattacagtgaagcaagatatcgtacattatcttatggaaaatccacttgtacttacaaagttagcgtgtggggaagctagtttaataggagttccggataaactgttacctgccattgttgagatttttgaaagggacttaagtcaatcaaaaaaatgcaggggaattttttgggaacaatgattgagagagtgagatctattgaaaaaattcattagaaatttttcgattgtattgttattcgtcagtctcttttacgtcgctcatattatatattttactcaaaacggaattttggtaggaacctatgtggttgaaaacaataaccatgaattgcaggttgtaaaactctccaagtctacgtatggtaaatatatgggcttaaaagagggagacaggataattgaaataagcggaaaaacaccgacagaagagaatataagaggtcaatatctagcgaaagctgaacatatgaaaataataaggggtaatagtaaaatagacttacataatactgagtttatttccttaaatagctcttatagtttttttatctatattatcccatgcatattatttgctttaagcatgttatgcattttttatatttataaagttaacagagtaaaagatacttattcagcctttattttgattatttttttattgtgtacatccattgcatatttaagcgcaggtggagtaactagaggatatgaaataaacagatatattaacctttttacatttttgaacgtacctgtattatactttcactttttgtatcaatactttaaagaattaaaattgaaattttcagctggttatgttgtgtctactctctatatattgccggttattaatataataatcgagatattccagaagcattttgccttccaacttgttacgaatattaatttagtaacattttttttggaaatgatggtcgtctatacatccattattttttatggactagtctaccgaaaaaaggatcacttttatttgctgaaagtattacttatatctaataccatagccttttttccgtttacagtattttatattatacctgaggtgttgttcggacagtatatttattctgctatagttacggcaccatttttaataattattccattagctttagtctatcaattcgtggtcaataaaatctacgatatagacttcttgttgggcagaattagatactatggtttcctttccattattccgactattggagttgtatggctgaatatattattcgacagcaaggggaataactttaacattattcaaatcactgtatatgtatttttgatttttttagcggtattttatattaaggagttattagactacaaatttcgcctgaaacgtttttcagaaaaatataattatcaagacagcatatttaaatatacacagcttcttaaaagcgtatcagctttaaaccaagtgtttatgaatcttaaaaagacgatattagatgtgttgcctgtcagtaaggcatatatctttgaaatcagttctgacggagatattctgtattttgataaacagaacagtgaaccgaactggcagccgtataaaaaagaatttgttaaagtctcatcagagattggcaagatttttgaagtaaatcaaggttttctgatgaagattggagaaagaggggcaaactcatacgttctgctttgtttgtcgagcattaatactccgagactgacaagagatgagatatcttggttaaagacattgtctttttatacaagtgtttcgatggaaaacatattgcagatcgaagaactcatgaaccatttacaagacctgaaacaacaaggctcaaacccggtctggctcaaaaagctgatgtttacgatcgaggaaaagcagcgttcggatttggcccgtgatctgcatgattcagtgctgcaggatttgatttctttgaagcgccagtgtgagctgtttctggccgattttaagaaagaggagccttgccagttagaggtgcaggacaagcttcatcagatgaatgagcagatgtcggatgtcattttgatgacccgggagacgtgccatgagcttcggcctcagctgctgtatgatttgggtctggtcaaggcggtatccaagcttgccgcgcagcagcaagagcgtgcgccgtttcatatccgtctgaatacgggccggtttacggcggcgctggatttggatacgcagctgaatttgtaccgcattattcaggaatttctttcgaacgccatgaagcattcacaggcgaatgaggtgctgattatgctgatcagcattcaaaataaagtgattctgcattatgaagacgacggtgtcggctgcaatcaggaagaaggcggcggacagtcgatgagcatgggtctttcgggtattaaggagcgcgtccgtgcgcttgacggacggatgaaaatcgacacaagtgaaggaaacggttttaaagcggatattgaaatggaattgtaaccattttatcaccaaatcgacttggcagaagccaagtctttttaataaaatggaaatgagtgagtaaaagggaggaaaccatgaaaaagatactagtgattgatgatcatccggctgtcatggagggcaccaagacgattctggaaacggacacgaatctttctgtcgattgcctcagtcctgatgccagtgaacaattcgttctccggcatgatttttcagcttacgatctcatattaatggatttaaatctgggtgatgacatcagcggcatcgagctttccaagaaaatcttaaaagagaatcctctctgtaaaatcattgtctacacaggctatgaggttgaagattattttgaagaatccatccgcgcgggcctgcatggcgccatcagcaaaaccgaatctaaagagaaaatcatgcaatacatatatcacgtgctcaacggacagattttagttgatttctcctatttcaaacagctgatgacccagcaaaaaacaaaaacgtcttcttcccctcaaagtgagcaggatcggttaaccccgagagagcgccatattctccaagaggtcgaaaaaggtttgaccaatcaggaaatcgcagatgcgcttcacttaagcaagcggtcgattgaatacagcctgacatccatttttaataagctgaatgtcggctcccgaactgaagcggtgctgatcgccaagtcagataacgtactataaatcttgaagggagaatgacctatgaatctgaacaatacattgctcggcgcactcggtattgaaatcactgaaaacacgccggagagatgcgtggcggtgatgccggtggataagaggacggtgcagcctttcggatatctgcatgggggcgcgtcagcagcgctggcggagactgctgcaagtgtcggggcccagcattttatcgaccggtcgaaacaggcgtgtgtcgggcttgagattaatgccaatcatttaaagtcagtgaaagagggcggaacggtcacggcgatagcggaacccgttcacacaggcagggcaaccattgtgtacgggattaacattttcgatgaacgagaaaggctgatctgtgtttcccgctgtacgctggctgttataacaaaataaacaaacagccggaaccctgaatcgtccggctgtttgtttttacaaatatgaatcttcttttcgtttgatcacaaagtttctgatccctttgtaatcatcctgaacgcttcttttatcaagcgccgctcccgaattgtacgcggccctgcatatgaggtgcgctccgaccggcgccgtcagcaggataaaaatgatgccgagcagtatttttacagaaatttctccggtcagcatccacaagtagcctaacaccccgagcaataccaaattaacgccgagtgtcgagccttttgaagaggcgtgggcgcgcgtatacacatcaggaagcctgagtgtgccgaaagacgcgaccaggcagatcagcgatcccatcagaatacaaacggcgacggcccatttaacgatttcgatcattttcgataatctctcctttctccaaaaacttagcaaaggcaatcgtgccgataaacgataaaatgccgagcagcagaatgatgtccaaaaaggccgatgtgtttaagagaatggatacaagcgcggtcatggcaatcagattaatgccgatcccatcaagcgcgacgacccggtccggtatcgtcggccctttcatgacgcgaatgacgtacagaagagtcgaaaccgccataatgccgagtgataattgcagaataaacgtaaacatcagcggctcacctcctgaatggctttttcaaaagagacgcggatgtcgtggatcgctttctccgcatcttcaatatccatggcgtgtatatagagaatcgaccggtcatcggagatatccatcacgagcgtacccggtgttaaagtgattaacagcgagagcaacgtgatctcccaatcctccgtcaattccgtcttaaacgcgaaaatgcccgggcggatgttcagtttcggcgctataacggttttcagcacgctgacattggccaaatataattcctttataaagatcagcaccagtctgatgactgaccatattttccaaatgtaaaacggccgcgagaagaagcgccggaaaaaaaacagcgccgccaagcctgcgataaatccggttataaaacccgccgtgctgaggctgtttgtgagaaacatccagcaaacagcgagaagaacgtttaataatagttgaaaagccatgccatctactccttcaaaacagcttcaatgtatttttccggattcagcagattctcagccgtctgattgacatacggtgaaacccattcggttccgagcccgaacagaagcgacaaaaggagaaaagcggctgccggataaagaagtccttttgcggaccgtccgcctgcgccggggatttctttttcttcgccccaaaaagccgtcgtaaaaaccttcagcaccgaatagagcacaagcaggcttgatacaagaatcaatacggaaaacaatgtttcccccttatcgaacccgccttccgcgatcttcagcttgcccacaaatccgctgaacggcgggatgccggccaaagatatggctgaaataaagaacatccatcctaaaacgggataacgggtgatcagtccgcccattttatgcaggctggcagtgcctgtcaatgcgataagcgtgccggcaagcataaacagcgctcctttaatcagcatatcgtgaatcaagtaataaaccgctccttgaatggaggccggcgtgttcatggcaatgccgaacaaaatcacgccgacggctgtaataatattgtagatgacgattttcatgacatccgaaaaggcgatagatccgattacgccgaatagcaccgtcagcatcgcaagccacatcatcaattggtgggtaaagcccgtatcgtgaataaagatcagggtgaatactcttaaaatggcatacaggccgactttcgtcaaaagagacccgaataaagccgaaattgcagccggcggggcgtaataagagcccggcatccagaaatacagcgggaatatcccgccctttaaaccgaaaacgacgagaagaaggatgccgatgacggttatcagcccggtctggcccgattcgcttatttttacgcttagatcagccatattcagcgtgcccgtcaccgcatataagtaaccgacaccgatgacaaaaaacgcggatgacacaatgttaaacacgatatacttcaatgattctcttaattgaattttcgttccgccaagcacgatcagcatgtaggacgcgataagcagaagctcaaaaaagacgtacatgttgaacaggtcacccgtcaaaaacgctccgcttacgccagccagaagaaactgcacccctgaataatagaaagcgcgctcccttttttctccgatggagcggaaggagtacagggtgacgagcagcccgattatggcggttgtcaaaacaagcagtgcggcaagctgatccgcggcgagcacaatgccgtacggcgctttccagccgccgagtgtcagcgtctgaatcccgtgtgtgaaaaccgtctgaacgagagcggcgctgatgacgatggagacacaggaagcggcagtgctgaatatccgcatcagcatcacgtgcctgttcataaaaatcagcagcactgcggcaagcagcggcaccagaataggcaatatcacaaagttattcatgttgatcatttcccctcattcgatccatatcgtccgttttcagttcctgataggcgcgaaacgccatcacaagcaggaaggacgtgacgccgaacgaaataacgatcgccgtcagtatgagtgcctgcggcagcggatcgacaaaggacgtgctttttccgcccagtatgggaggagcgccttttttcagtccgcccatggtcaggagcagcaaatggacgccgtggctcaaaagcgcggtgccgataatcacgcgcagcagacttttagaaagcagcaggtaggttgccgccataaacaaaataccggcaatgacagacattaagatttccactattcttcctctccaatcgtttgaataatggtcatcgtcacgccgacaacaacgagatacacacctaaatcaaacaaagtggccgtcgcaagctccgtattcccgagcaccgggagatgaaaatggccgaatgtatgggtgagaaagggcgctccgaataagaacgaacctgcacccgttgcaatcgcgataagcagacccgcgcccgccacataaataaaattgacgggcaaaatcgatttgacggtttttaaatcaaaggccaaaagcagcagcacgatggccgaagacgtaatcagtccgccgacaaatcctccgccgggggcgttatgccccgataaaaataaatagaaagagaaaagcagaatgataaaagatacaagcttcgttgccgtctgaaggatgatgtcgtttgtttttggctgtctcaacgcttttctccctcctctgttacttttgttctgatcatgccgtaaatcccgagtgcggcaatcgacagcaccgtaatttcaaacatcgtgtcaaatcccctgaaatcaacgaggatgacgttgacgatattgtttcctcccccgagcttatggctgtaagcggtgaaaaaggaggagatgctgtcttttgttttttcgctggaagacgcgattccgagcattgtcacgatgacgccgacaccgagagaaatgataaaattcgtcatccggaatgttcttgtcttctttttccgccgcattttcggcagatggtaaaaacaaagaagaaacaaggcgacggatatcgtctcaatgacgagctgcgtgagcgccagatcgggcgctctgaaaatcacgaaaaacagcgcgagtgtgtacccgacaacaccgagtgagataatggccgtcagccgtgatttggcgaacacagtcgcaatcgttgcgttcaccataacgagggacagcacgatttcatacaggccgatctcagccattcctttcgctgtcatggaaaagccgcctttcatgacgaacgccgctccgatgagaatgataaacgacgcaaagatatacagcagataatcccgcaaaaatccggtcatataagatgacgtcagctggtaagatcttttttccatactgcccgtcaccgcatcgtaaagcttgttcagcgtcagttttttcggaaacagaccgtacagacgctcccatttagacagcgttacgtaaccgatcgtgccgacaatgatgatgccgagggtcatcattacctcagccgtcaccccgtgccactgggaaatatggacatggaatgtatctccgccggttaacagagcgggataaatggagttcatcgccggttcaatcaggctgtaagacaaaacgttcggagcaaaaaacagactgacggcgcaagcggcaagaatcaccggcgaaatcagcatgccgagcggagcttcatgcggcgtcttttcaagctgatccgttttgcgcgcgccgctgaacgttctgaaaaacagcttcatgctgtagatgaaagtgaagacgctcccgatccatgcgagaacggggaacagcacgccccacgtatccaggctgaaaatatctgcatgagcaatccgcagcatacttgtaaagaacatttctttacttaaaaagccgttaaacggagggagaccggccatggaaaacgttccgatcagtgaaacggtgaacgttaccggcatgagcgccatcaggccgccgagcctgcggatatcccgcgttcccgtttcatggtcgataatgccggccgccataaataaacttcctttaaaagtagcatggttaattaagtgaaacacagccgcggtgacagccgccgtaaaatactctgaatgctcataatgaagcgcggcggctcctgcgccgagcatcgatacaatcataccgagctgactgactgtggaaaatgccagaatcgcttttaaatcggtttgtttaatcgcattaaaggaagcccataccatcgtgatcagaccgactgaggcaaccgtccaaaaccagacgggtgaaaaagcaaaaaccggactgaatctggcaatcagataaatacccgctttcaccattgtagccgagtgcagataggcgctgacaggagtcggcgcctccatggcatcaggaagccagatataaaacggaaactgcgctgattttgtaaaggcccccaataacaggagaaccatcgccggaataaagaacgggtggcctgcgataatatgcacctggttgaccatttccctgatactgaaagaatccgtcatcagatacagcaggataaagccgccgagcatgcacagcccgccgccgacggtaatcagcagtgatttttccgccccgtagcgtgatttcttccgcttatgccaatacccaattaataagaaggatgacaggcttgtcagctcccagaacatataaagcacgatgacgttatcgacgagcacaacgccgagcatcgcgcccataaacatcagcaggtacacataaaaagggccgagcttttctttgtccttcgataagtaaaaaatactgtaaagcgtcaccaaagagccgatgcccgtaatcaataaagcgaataacagcccgagtccgtcaatataaacggtatagttaataccgagggacggaatccattcggccgcataccggacggtttctccagccattgtgacagggagcttgctgataaagtaaacaaacagcacaacgggcactatcagcacaaaccagcctgtatggacttgttttacccgtttataaagaaagggaacgataaatgcaaataaaaaaggcgccaaaatcgcgaaatgtaacagctgcaacagaagacctcctttgcttgttttttcatcaagcaactgctttatgtaagaatgaatcaatcaattcacggtcataggacccagtacaaattatatcgcacttttttttaccctgctacggcataatgtattcctctttgtgtttttgtggtcttttgaacccaaaataaatttatcaaatatccggatctttgtatatacatttctttttcagatcaagctttacaaaaggagctggtcagatgaagagaaaggcggcggcctgtattggaatattttgttctattattgcaggaacattcatagttgatgatttctgcaaaacgcggcagcagacggaagcagatgattgggagcatttttttctcggtgcggaatacgcagaagacaagctgagtgcggctgaatcaatgcaaacgccgtttcagccgcgtgagtatatcagaatcgtatatagatgaaaagagttccggcaccagggtgcggaactctttttgtgtggcaatcagcgttttcctttaatataagggatgccgttggctttaggcgcatccgcgcggccgatgaagccggcaagcgcgagaatggtcagaatgtaaggagccatcagcatgtatacattcggaatgtctttgaacaggggcaaaagcgagccgataatgctcaaactctgcgcaaacccgaagaacagcgcagccccgagcgcgccgatcggatgccatttgccgaaaaccagcgcggcgagagcgataaagccttgtccggaaatggtggagtgcgtgaaatcaagcgcgatcgtggaagcatacacaccgccgccgagcccgccgaacagcccgctgatcatgacgccgatatagcgcatgccgaacacgttgattcccatcgtatcggccgccatcggatgttccccgacagaacggatgcgaaggccgaacggcgttttgaataaaataaaccaggaaacaaaggccagtacgatggctaaaatcgacgtataatatacgtctgaaaagaaaatctttcctaaaaccggaatatcgcttaacccgggaatgttcgttttgtaaaagggctccgggattttatcagtctgcgcctttccgtaaatcagtttgacgataaacagtgtcgctcctaacgcgagcatattgatcgccacaccggttaccgtctgatcggcgcggaaagaaaccgcggcagccgcgtggatcagtgagaacagtccgccggcaatcatagccgcagccagagcgagccacggagcggcggcgccaagctcgcgtccgaaaaataagttgaacatgacgcttgtaaaggcgccgataatcatcagtccttcaagaccgatgttgacaacccccgatctttcagaaaacacgccgccgagagcggttaaaataagcggagccgcatatacgagtgttgccggaacaataatggataaaatctgcaggaagtccacttacttcgccccctttttcttcaatttatcaaggatgagacggatggcgtagcttgatgccacaaacaaaataataatggcgatgacgatgtcaacgacttcagaaggcaccccggattcaatcggcatatttaatgccccgactttaaggccgccgagaagacatgccgccagaacaacgccgattgccgtgctgccgccgagaagcgcaaccgcaatgccgtcgaagccgacgccggtaaaggcgcccttaaccgccgcatattgaaaggttccgagtccttccatcgcgccggcaagccctgcgaaggccccggaaatcatcatggcgtacatcatattttttctgacgctcattccggcgtattgtgcggcgtgctggttaaagccgacagcccggaattcaaatccgctttttgttttatgaatgataaaccacatgaggactgccgcaaacagagcgatcagaatgccccaatgaaggcgggagtaatctgtcagctgctctaaaaacggcgagcggagcgacgcgctttcatgaattttgtctgttttgtcccggtggtccgtcatgacatcggaaatgagataattggttaaatgaagagcgatataattcatcatgatcgtgacaatcacttcgtggacaaaaaaacgggcttttaaaaatccgggaatcaggccccaaatgccgcccgcagccgcagccgccaataacgaaagcggaaggtggatgtaagcggggcgtcaaaggaaacgccgacccacaccgcggcggtccagccgacaaggagctgtccttcaaccccgatattaaacaggccggtccgaaatgcgaatgccacggccaatccggacagaatatatggcgtaatctgccggatcgattccccgatgtaatacacttcaccgaaaatgccgctccaaagagccgaatacccgcttacgacattgtagccgctggcgagcatgatgaccgcacccgcagctaatccaaggatgatcgcaatcagcggcacagccagatgagaaagtcgattaatcatgtgttttccccgcctccatttgcttacttcccgccattaaaagtccgagctcctgctcgtttgtttcaagcggattgacgtttgcgatgatgctgccttcaaagatgacggcgatgcgatcgctgagattcattatttcatcaagttcaaaagataacagaagcaccgctttaccggcgtcacgctgctcaatgagctttttatggacgaattcaatcgcgccgacatcgagtccccgcgtcggctgggccgcaattaaaagatccggatttctgtccacttcccggccgataatggccttttgctgattccccccggagagagcgcgcgcaggcgtatattcatcaggtgtcctgacatcgtattcttcaatcaggcttcgcgctttgtcataaatcgtgtgtttatttaatatgccgaaagaagagtagggcttttggtaataactttgcagcacgatattttctccgatcggaaaatcaaggacgagcccgtgtttatgtctgtcctgcggaatatgcccgattccggcttcagtgactttcctgggcggcatattttgcagctgtttgccgtttaacatgatcgtgccggcatttgtttttctgagacctgtaatggcttcaattaattcagactggccgtttccgtcaacgcccgcaatgccgacgatttcaccggctctgacagagagggagagctgtttgaccgcctcaacgccgcgcgcgtctttcaccgttacatcagaaagcgaaagcacttcttgtttcggttcagccggctgtttatccgtcttgaatgacacttcgcgtccgaccataaggcttgccagttcatcttgatccgtatgtgcgacatcaagtgttgtaatgccttttcctttccggatgatggtgacacggtcgcagacttccataatctcttttaatttgtgggtgatgaggataattgattttccttcattgacaagatttttcataatctgaatcagttcttgaatttcgtgcggagtcagcaccgcggtcggctcgtcaaaaatgagaatgtcggcgccccggtagagggtctttaatatttccgcccgctgctgcataccgacggagatatcggcaactttggcttcaggatcaatgtgcaggccgtaacggtcggaaatatcacgcacgtcccgggcggcgcgctgtctgtcaattcggccgaaagttttcggctcttttccgagaatgatattttctgagacggtgaaggtatccacaagcataaaatgctggtgcaccatcccgatgccgagatcgttggctttgttcggactgttgatgtgaacgcgttcgccacgcacccggatctcgcctttttccggctgatacaggccgaataaaacgttcatgagtgtcgattttccggcgccgttttcaccgagaagggcgtgtatttcgccttttttcacttgaagcgtgacgtcatcattggcgacgattccgggaaattccttgcgtatattaagcatttcaatgatataatccaccgatttgtcgctccttttcagagatactttgatgagaaagagcttggcaaaagaaaagctgcaagagatgcagcttttccttcaccgctcttttcaaaaaagagaggggataagcacgaaagtctccttatcccctggttcttactcagccttgaaggatttcaattctttttcagttgaagggatcacgagtccgtccgcgattttcttcttccaatcgtctgttgctttgatgacatcgtcagaaaggttctccttgtgatccgagatgccgactgcatcttgcgccaaaccgtatgttaatgttttgccgcccgggaatttaccgtcactcgcttttttcgttaagtcctccacggcagtatccacttttttgaccattgatgtgagagtgacattgtcttttgttcctttgacttggccttccgcgtactggtctttatcgacaccgataacccatacgttccgcttcggatcttcttttttcagatttttcgcttctgtgaagacgcccgttcccgttgcgccggccgcgtgataaatgacgtcaacgcctgatttgtacatgctttcagccgtcgccttgccgacatcggctttgtcaaacccgcccgcatatttcacttcgacggtcgctttcggatttgcggcttgtacacccgcgcggaagccgatttcaaattttttgatcaattcggactccattccgcccacgaatccgacttttcccgttttgctcgatagcgcagcggccgctcccacgaggaatgaaccttcctgttccttaaatgtaaggctcgccacgttgtcttttttgacaacggcgtcaatgatcgcaaaatgtgtgtctttgcgctgatcggcgatttcgctgatggaatcctgcatcagatacccgacgccgtaaatcaggtcaaagtgttcccgcgctaatttatttaagttcgttgtataatctgcatctgattttgattgaagatagtcaaaaccgcttttgccttttttaagcccgttgtcttttccgaatgcctggatgccttcccaggcggactggttaaatgatttgtcatcaacaccgccgatatccgttaccatgccgacggtaaagtttttgctgccggagccgtttgctttgtcacttgaaccgcatgcgcttaatatggttccggccgctgcgatgagcgccatcgccattccgattttgcgttttttcaaagatataacccccctgtaaaatatggctgtgccgttcaattcagacttgagtccccgtgccggatgcagaatcgaaaaaactttctgataataatgatgagacgtctctctttttcccgccttgagcggctgtctcttccgggttcgggacttatgacttatctgaaaagatctgctaaccaatcataatttatcattttacccgccataaataaatagaaatttgcttattttttaaaaaatatcaattttatgaatcggcttcctcatctggttaaaacagaggaggatcagccgggtcattatccttatatagcatatcaaaaaggaatctcaagccttttgtcacgggatatgacagtaaaaaagcaccgttcacagcgaaacggcgctttttgacattataaatattgtttgatgctgctgacattgccggtgttgatatgatattgaaagacgggtctgccgatcgtgccgtacgccatctctacattcagcacttgtatgtcttccagaaatttaaggtatttccggatggagacttgcgagatttcagtatgcttggcgagatcttccgtggtaaaagagccgtcgccgaaagactcaatgctcgcccagatgagtttaagcgtgctctttgtcaatcccttcggaaggtgaaccttttccgccgcttctttcttttgaaaaagctcggcatccaattctttctgtgtcatgcttctgtgtgattgataaactttctgcttgcgtctgtagtcggaaagagcggtttgaaagcggtcaaattcaaatggtttgattaaataatcgacggcgccgtaccgaagcgtttttttaatgacgtccagctcgcttgcggccgaaatgacgatgacatcaaccgattcattctgcttgcggatttccgttaaaagctcaagcccgttttttcccggcatgtaaatgtcaagaaggatgagatcgatatgatgctcgctcagcacgtgcagcgcgctttgaaaggatgatgcgatccctttcagctgaaatccttcaatctggctgagatagcgcttatttaattcacccaccatggggtcgtcttcaactatgagtacattaatcatcattttcctccttcggttcatacggaatgcgaagactgaaagtcgttccttcattcttttcacttgtcacaatcatatggccttttaaattttctgttgcctgctgggtgaaatagaggccgaacccccggtttgtccctttcgtggaataaccttgttcaaaaatacgggcttggtctgccgcagacattccggctcccgtgtccgtaatctctatgtcaagctggcgatcctgaaaccgcatcgagcacgtaatgttttttttcggcatctgcgccaccgcgtcgagcgcgttgtttaacaggtttccgataatcgtaatgagctcatggatgacggccggatccgccgcattcggaatcaggctgccgagctgaatgtccagatcagcgccctgctcgcgtatgtagctttgttttcccagaagaaaccctgcgagaaccggacttttgacatcacttataatctcgcttgtttccgtcttctgctgaatggcaatgtctttaatgtaagtgccgagatcatcgtattcttttaactggacaagccctaaaatgacatgaagcttattcatgaattcgtgagactgggctcttaatgcgtttgcatacattttaacaccggacagctgttctgctaaatgtttgacctccgttttgtccctgaacgtggcgatcgctccgacggtttgtcctttcagatgaatcggaacttcattaaagaccagctcaagtccgttaatgcggatatctctgtcctgaagcggttttttcgtttcaatcacctgtttcagccggcttttcgggagaatatcgttcacatcttgatcgaccggattagtcggaatacccattttaataaaaagtcgtttcgcctctgcattggcaagcttaatttttccccgcgcgtcaaccgcaaggatgccttccttcgttgattcgagcatggcgctccgctcttccaggagggtggcgatttcataaggctcaagaccgtacataatgtttttgacggtgcgggcgacaatgacggctccgatgacgccgacaaaaatacttacgcagatgatgaaataaagcggtctcaaactgtggctgacgacatcctgtattttgttaagcgaaattccgaccgaaacgacgcccacttgttttttatcttttccatagatcggtacgaaggctctcatggattttccgagagttcccgctgatgtgctcgttttgatatggccgtgcaacgccggctgttcgtctccgccggtgaatttcttcccgattttatttgcgtcggggtgggtgaggcggatgctgttcatatccatcaccacgacaaattcggttcctgtcgtatgctggacatccagtgtataattccggagctctttcagcccttttcttgtttgcaatgcctgcgcgacactcggtgtttccgcgacaagctttgcggtgcgcagcgcggttgtccgttcttcttctttcacgcggtccgcggtctggacgctgatcgtgaaaaaggtgatacaaagtgcgataaggacgacaatacagacgaatatcgttaaccgggtttgcaattttaatgtttttttcataacagccttccttacgtttatcattcccgcgttctactttactccgaaaaagccggtttgtgaagatcaggcccttatttcgtaaaagtgaggaaaaatggaattttttatcttgtcaatgtgttttaagtcctccataataagtgaggtagattacagaaagggactttttatatgaaaaatacttattggacgggttattttccgctcgttgcgattctgctttttagttcgtcattatccatttctacctcgctttatgtcatgaagatacttcagacgctcggcatgtatcaggggatgctggattatttctctgagaaagggatcagactggcgctttttgcagcgttcgcccttgtgtattttatgcttttttcggctttgaagctgattgcaaacacagtgacagagctgtctcttttgtttttcacaaatgaccctgagggggacaatctgaaaaaaatcagattaggctctttaatttatgtaggcggaggaattctttcctttgcgttcgtgcagaatggtttttggattgcggcgttatttgccgttgttacgctcatttatttgattttcatggtgtacagaatctattcgacactctcgatcgtttcgctgatcggttttatattgcttgagattctgttttggtttacttttgttatcggtattttgtacatctttatcaagctttataatagcataatggctagcttacctgtgtaagctagccatttttgttaagacagaaatctgtttttgatctcaggggaggggagcatgcatgcttccctttttccgaaccatttgtaacggcgccgggcgatgaaagaataggctctgtccctgaggggcggggcactgcgaaaaaaaccgctgacagccgccaggctccgcggagatgacgcgaaacctttaacacggctgcggattttttgtatatccgcccgttttcgataaaaatcatgctgtcaaattgttctgtcggaagtccttctgatgccaaaagctcccgggcggtatctgattgcaatgaagcaaatgagattttgccggccggatcgcgtttaatgatgaattgaacggcgccgctgcataagttgcagacgccgtcaaacaaaagcacgcggtccggaagctgagctggtttcaaagcggatcccctccgttatctttaataagctgcctgcagcgtgtttttccagatcgaaagctgagggcttgcgtcatgaaggtattcgacgcttgacggtgtatccttgccgacccataccccatcgtataagcgtccgtcaggccgacaaaccacatatcgtgatagtcatttgacgttcctgattttccgccgacgtacggagctttaaagttcgctttttttcctgttccgcttttgacgacggctttcatcatttctttgatctgcatgttggtccgcacgctgaatacctgcgccggctcatctttccattttaatatcgtttttccttttaaatcagtcacttttgtaatcgcgtgactcggcgtataaacgccgttgttgccgaacgtggtgtacgcattggtcatttcaagcggcgtcatgccgtttgtaaaaccgcccagcgccgcaggcaggcggtaatccgcgctgaccagcttcgcgaaatgaaacggttcaaggtagctgaacgccttattgacgccgacgcggtccatgattctgatggccggtgtgttgtacgagtatttaaacgccgtttccagcgtaaccgtgccgtatgtgcggttattatagttctgcgggcagtaatccgcactgcagaatttgcttgcgtcaattttgctgtgtggcgttgcgccggtcttttcaatgtaaggtccgtaatcaagcagcggcttaatggatgaaccgggctgtctgtatgcttgataggcgcggttgaaatcatatttatgataatctttcccgcctgaaagcgcgataatctgatgtgtctgatgattaatcacggccgctccgccctggacgcctgcatacggcagattttgattcacttgggcgacgacctggttttgcatatacggattcagcgccgtataaatcttcacgccgtcttttaacaatgtgctgactctgtcggaaagctcactctgtattttttgtttcgcctttccggaagctttttcaagacgtttgtcatagccttcggatgaggaaacaagctgtgtgaattcatcatttacataggaaacatagtcaggatatttatttgttttttcgtttatatcaagcttgatcttttccttttcggcttttttcagctgtttcccggatataacgcctgcttttttcaatccgttaagcaatctgacttgtcgttttttcgtataatcaaaatgcttgagaggatcatataatgtagggttattagggatggcgcagataaaggccatctctcccaaagtgagagatttcagcggcttgctgaaataaaattgtgccgccgaaccgacaccgtatacaccgttattaaaataaatcgtatttaagtagccttctaaaatctcatctttgctgtattttttctcaagctgataggaataggccagctccgtcagttttcggctgaaggtgcgttcatggcttaaatacacattccttgccagctgctgggtgatggtgctggcgccctggtcaattttatgatctttgaaattggaggcggccgccctgaccatccccataaagtcaaaccctttatgctcataaaaatggcggtcttcagaggttaaaaacagctgttttacctcattcggtattttattaaagggcacgatcacgcggttctcatgatcgctgacaatctcagaaacaaggcttccgtccctgtcatacatgtaactgttttgaaccaggttgatcgcttttaaatcaatatgtttatcgagcacctgatcaaaaggcttgatttgttttacctctttgccggaagcaataactgtaaatgcacacaacgggataatgccgagcagcaaaatccatccgattattttacgtaccatggtcactctcttttctcctgatttctagccatatcgtatcattcttttaagaatacgagaaggttaaatttagaagaaatcgtgatcgctgccggtcagcccgcatttgacgctgtatccttttgcagatgtcccgccatccataaaagccccgcgcctataaaaaagagaaaggcggtgacgtagaaagcagccgaaatagaaaaaccgcttgagaccgcacctccgagcagagggccgagcacgtttccgagaaaacgaaagctgacgttatatccgagcacctctccctggatgctgcccggagccctgacgcggatcgcggccgtaatgcaggggagcgtgccgcccatgaccatgccgaacagaaatctgaagactaacagaatggagagggaggaggcgagcgcctgcggaataaaaaacaccgctgatgcaatcaaaagcacgattaagatccggctgtggccgaagcggtcgccgaagtcccccatttccgggcaagcaataagcttccgagtccggtcgctgaaaacgccattccggagaaaaaggctaaattaacaggtccgtgcagctcattgacatataaagcgagcagcggctggatgctgaaattgccggtctgcacgatcatggtaagcaccatcatcgcccaaagcgcgggctggtgaaaaatataggagagcacctgttttctggaataggttttccgcttgttttgtttctcgccgagcggctgctcattcacctgaaataaaacgagaagcacagatgcgaaaatgacaaaagacgtaataaaaaatgtgtacgtaaatccgaagctgtcagcgagcagcccgcccagcatcggtccgaataaagtgcctgacacctgacccatctgcagcgtgccgagcgttttcccggcagtctctttcggcgtctgcgccgaaatcatggcaagcgaagtcggaacaaagcccgttacaaggcccataagcagccggaggacaaacagctgataaacggatgtcacaaaccccatcaataaaatgctgacggcaatgccggtgcctgtgatcaagagaatttttttgtagccgcgcttatcgccgaatctgccccaaaacggggaaatcacaaacgccattaaaaacgtgacgccgaacacatacccgctccatctctgcacatacccgcccgaatgggggctgatcgtttcgatatataacgaaagaaacggaacaatcatggtcatgctggcggaaataaagaaatttgtaatccaaatgacgacgaagttcttcttacggacagaaataacatcaccttctttaattttcgtgtgtctaatcattagtatataggaatgaatccggtatttgtattttcgatgcggatataggaaaattcattatttttagaaaatgaagaaagtttcagaggggaaactgatatactatcataaaatatcatttttgatcggaggaaaggcaggtgtaaaaaagtggatcagcgcagtctgctcattattgattttgaatttacgatgcctgacggaaaatacagcccgcaaaatttctttcccgagattattgaagcggggattgtcaagacggtgaatgatgaagtgactgaaacgttttcgagttatatcaaaccgaaaaaatttccaaagctgacgaaacgatgcaaaacctttctgaacatcacccaaaaagacgtggacggcggaatcacgtttaatgaattcatccgcaaattaaatgagcttgatcctgataaaaactgcacgatcgtcacctggggcaatatggatatgaaagtgttaaagcaaaattgcatgtttaaccacatcccttttccgttcaaaggagaacttcgggatctgtccctagaatataaaaacttctttggcgacagaacattgaccggcctttggaaagcggcggaagagtatggcgataaagggacgggcacgcatcataaagcgctggatgatgcgcggacgacatacaaattattcaagcttgtcgagcgggataaacaatatcttgaaaaaccgaaacccccgacgatcggtgatcgcgtcgatctgactgaactgtttcgacgggccacataaaaaaacccaatcatgccgactgggtcaagttcttttaaaatagtcacgctctaacgcggccaagttggcgagcgaacgttccgcccattctgagccgtccgctgtaagctgatctttcagccgggcagacgccgcttgtaaggaagccgtataatcaggaacttcgccatcaaacggtttgaccatctgatgcggtatgtttgtctgttccccgaatgcaagcgctcttctttcatgaaagaacggaacatccgcctgcttcggatgatgaagatctccttgagcgggatgcgtcagaacggctttaattttcactaaatagtgattgggcctgacgtctgtcacttcccctatgtatgctcctgttttataaaacccttttacgattgtgccgatttcaaacgaattcatagcgttcacctctctctagttattctataaaagatcaacgcgattggctagtgaacagctgccggaagcctgactgaagccgttgtgcccgagtgctcgccgctggtgaaatagacggagccttcatgatgctgaataatcgagaatgtcacggtaagcccgagcccggtgccattcgttttcagcgtataatacggtttgccgagtttctgcagttcttcatcggacatgccgattccgttatccgtaatctgaatgagaatcatctcttcctgtttttggacggagacctcgattcggccgttttcagagggcacggcttcaatactgtttttaatcagattaatgaaggcctgtttcagtttttttacatcgccgaacacatataaatcaggctcgctttgaacagtcacggtcaccgatttaaaattagcataagactccattaaggaacctgtttcctttacaagcagagaaatatcaaacttttctttttcatagtcatcctgcttcgccatatcgagataattcgtaatgatcgtctgagcccggtcgagttcggacagcacaagtttctgatatccggagtgggatttgtcctgaagctgctcgccgctgaacagcagctgcacaaaacctctgacgaccgtaagcggattgcggacttcatgggcgacgcttgccgcaagctcgctgacgacggccattttttctgagtgaatcagccttgcccgcatggacgcattctcatcaatgatctcaatcaaataaatgcacagcaaaagggcgctgacttgaaaaaaaacggatactgccgcctcataataaacggaagatagattttgaaaattgaaaatattggtcgcggaatagatgaagacagatgcggttaataaggcggtttcagtgcagccgatgagaagagcgaaaagcagtttcttccgctttgagaaaaaaggccatttcgtttggagctggatagggatgatgattaaaaaaggaattaaggataagaaaaaaagagcggaaggttcaaaccatatgagctgaaaaaaaacggatgctgcccctgcggcaagtcctgctgcggtaccggaataaagcaggcagacgataatgggaatcagctgcaaaccgtaacggacggaatgaagctcctggatgggaaaagccgtacataataaggaagatgacgctgcaaatacggcgaccagcaggcggttcgctctcggcacaagcaaatcgggcttgctgagccagaagacttgatagagaaaaatagggaataaaataaaagagaagtgaagcaggtaatcctttacaatctccatttatgcgaaatcctttcctatgtaaatatgaatctattataacatctttaccggcaaaaaaagtatttatttctctaaagcgaacgcccttatctcatctgataaaggcgttctttccgctgctaagagagcgctgctttcattctcttaagcccttcttttacggcggcggctgaacagccgacattaagtctcataaatccttcgccgcccggtccgtatttcgttcccggctctaatatgattttcccttttttgagcattctttctttgagctcggcatccgaaaatccgtatccgctgaaatccatccagatcaaataggaagcgtcaggtttcatcatgcggactttcggcaattcttttcttaaaaagtcctcagccaatttcatattcctttcaatgtaaggaatcagtgcgtcaagccaagggcctccctttgtataagccgcttcgattgctgcaaccgcaaatgtgttgaggctggaaatcccgttctgatgcaatgcggcggagaatttcgcccgcttataacggtcgggaatgataatggcggatgcctgaatgccggcaatattaaacgtcttgctcggcgcgacacaagtaatggaaatccgcgcaaactcctcagacagagaagcaaaaggcgtatgcggctttccgtacagcatcaagtcggaatgtatctcgtcagaaacgacggtgacgttatgagcggcgcacagcgatccgagctgcataagctcatcccggctccacgctctgccggacggattgtggggattacaaagaatcatcagcttgacctcagaatcgctcagctttttctcaagatcctcaaaatccatgcagtagacgccgttctcttcccgtaatgggttatgtaaaacctgccgtttgttttccttgatcatctgataaaaaggcgtatacaccggtgattgaatcaacaccggatcgcccggttcggtaaaggcttgtactgccatgctgattgccgtgacaaccccgggactgaacgtgatgcttgcgggatcgggccggtagccgtgccgtgtctcaagccatgaagcgacggcttctcttgtgttttcgtcaggagacgtataaccgaatatgccgtggtcaaggcgggcttttaaggcgtcagtgaccgcttcgggagcgcggaaatccatatcggcaacccacatcggaagtgcatccgatacgccgaataacgcttccgccttgtcccatttcaccgattgtgtgccaagacggttttctcgaagatcaaagttcatgtatgtcactcctgtagtatcattattttgcacagcgtatctatgataaaatagatttgcaaactttattataagcggtgatgaaaatggaagaaagccaagcggtcatggaaatgatgaaaatcattgccaagtgggacccatttaaatatggagaagatttttatgagacagaagccgtcgacatcgttcaggccgtctacagtgaagaccgtgccgacaagctggcagcagccattcaggatatctttgaagcttcatttgagcaaaagctaccgatcgaaggctgccaaaaggccgccgagcagcttctgttcataaaagaaagcagctcctgcaccccttaaaaaccggcggttccgccggttttttttattgaataaattcaaaaatccgttccgaaacaaactccgggcgctcttcgggtacgaggtgtcccgtatccttgagtgaatacagaatggaatccggcaggtcgtcatgaagccgttttccgactgagaccggaacgacccggtcttcttctccccatattaaaagagcggggttttgcactttcttcaaatcctcgggctctaaatcgccctccctgtgtctgatgaaccttgtcatcgctttgaaaatctggcggtctgtaaatggtttttcgtaaccgtcaatcatttcctgatcgataagcgtccggtcgtgaacgacatttaacaggtttttcagcacaccgtcttttgaaagccaatacttaagatacaggtcaaaacaagggaggtgcgtcccgaatataatcgacgggtgcgagcgctttaaataccccgagctgcacagcaggacgattttagaaaaaagctcgggtctgagaagagacgcggataaggaaatctggccgcccatcgaatggccgatgagtgcggcccggctgataccgagcttttccagaagtccgatcagaagcttggcgaggtttgcgtaagtatatacgaaagtccgtgacttttccgattgcccgaaaggaggcaggtcaacggcgataatatcataatggtttctgagcagcgggatcagttttctgaagctgaatgccgaagataaaaaaccgtgtacgcagacgagtgtctgtctgccgggattttcataatgctcgtaatacagttcaactccgtctatcgcggcccgtttaatcggtgaaacagcttccatgagagccttcgccgtcctttctttgttgtaatgtaaaggcttttttgattgtcagattttagttctggtttctttcgggtttttcttagcatttgtcgaaaatcgtgatataatgtcatgaagatttttgataatgcaaaggtgtgaaacgtatgaagctgacggaaaaagaaacagaaatattagaaattttagacgaaaacagccgcgttgatgcggaaacgatcgcgaaaatggcgaacattcccgccgaagaagtcaaaagcatcattgaaaagcttgaaaaggaaaaagtcatcattgattatgcggcgatgatcgactggcgcaaagtcgacggtttggaaggcgtcacggcgatgattgacgtaaaagtcactccgaaacgaaatgtcggctttgatgaagtcgctgaacggatatacagattccaggaagttgaatcagtgtacctgatgtcaggggtgtatgacttatctgtcgttattcgcggcaacacgatgtcagacgtggcaagcttcgtgtctgaaaaattgtccacccttgagtccgtcgtttccacgacgacgcactttatcctgaaaaaatataagcatgacggcaaagtctttgaaagcggagacgatgacaaaagaatcgtggtgtctccgtaaatggaaacgaagacttcttatttatctgactacgtgcagcagattaaaccgtcaggcatccgcaaattctttgatctggctgctacgatggaaggcgtcatttcactgggagtgggagagcctgactttgtgacggcctggaacgtgagggaagcgagtattctttctttagaacagggttatacggcttatacggcaaatgcgggtctttatgaactgagagaagaaatcagccgctatttagatcagcggttcggcctgagttattcgcctgacagtgaactgattgttacggtaggggcaagccaggcgcttgatctcgctgtccgcgccattatgaatcccggagaggaaatgttaattcccgaaccgtgttttgtcgcatatgaatcactcgtgaccctgacgggggcgaagccggtgccgattcagactgtagctgcaaaaggtttcaaagcatcagcagccgattttgaagcggccctgacggacaaaacaaaagcgctgcttctatgctcgccgtcaaatccgactggttccgtctattcgaaagaagagcttgaatccatcgcttccttcgctgaaaaacatgacttgatcgtgcttgccgatgaaatttatgccgagctgacgtatgatgagccattcacgagcatgggagccatccgcggcatgaaggaacgcacgattttgatttcaggtttctccaaagcgtttgccatgacggggtggagactcgggtttacggcggcgcctcccgtgatcagggatgccatgctcaaaattcatcagcacgcgatgatgtgcgcgccttccatggctcagtacgcggcgcttgaagggctgaaaaacggtcaggaagacgtcgaaagaatgaaaaaaagctaccggagacgccgaaacctgattgtggaaacattgaacgaaatcggactcggctgccaccaccccggcggagcgttttacgcctttccttccattcagtcgaccggcatgagttcagaagaattcgcggaacagctgctcattgaagaaaaagtagccgtcgttccggggaatgtattcggcccgagcggcgaaggctacatcagatgttcctatgcgacatccattgagcagattcaggaagcgctcgtcagaatcaaacggtttgttgaaaaaagggcataaaaaaagatacgaacccggttcgcatccaaataaaaggggggaatactagaaagccttcgtaatcatagtataccccctttatctgcgcttaaacatgatgatgtaaaaaagttctctttgcgaaaaacaaacttgtatgatataattttaaattgcgtataatctgtatttaatttaacttaggagttgttatgaatggcagcaaaatttgaagtgggcagtgtttacactggtaaagtaacaggattacaagcgtatggtgcgtttgttgcattagatgaagaaactcaaggacttgttcacatttctgaagtcactcacggtttcgtaaaagacattaatgaacacctttctatcggtgacgaagtacaagtaaaagtacttgcagttgacgaagaaaaaggcaaaatcagcctttctatccgtgcgactcaagcggcgcctgaaagaaaagaaagcaaaccaagaaaaccgaaagcggcacaagtttctgaagaaacatctgctccgcaaggtttcaacacattgaaagataagcttgaagagtggattgaacagtccaaccgcaaagaccttatcaaaaaataaccatcaaaaaaagcaccggatatgtatgttcggtgctttttttatgtttatctgacttccggatttgccgcttcctcgcgggatgtttcttcgttcggcttaaacagcaggccgagattgatcagaccggcgatgccgacaagaccgtaaataatccgcgacagagctgatccttggccgccgaagatggctgctactaaatcaaattggaaaaatccgatcagtccccagttaatagcgccgataatcgttaatacgagacagatacgctgaataacactcatgtaaacaacctcctctataaattcgtgaaacagttatagattgtgacaaagcaaagaatctatgcatactacattctccgccgtgtaaatcacacactgtctcaagctgtacaagtgcctttcccgggaaaccgctgtctgtaaaccgtgtgatgtgccgtcaaaaaagcggattgctttacattgaacgtcaactttctgcataatataaatccaaaggaggagatgtcatgcaaaactttacatattggaatccgaccaaattgattttcggaaagggagaggtcgaaaaacttcctgaagaaatcaagccgtacggaaagaacgtactgctcgtatacggaggcggcagcattaagcgcagcggtctttatgatcaagtaaccgacctgctgaaaaaagcaggagttaccgtacatgaattggcaggcgtagagccgaatccgcgtgtctcaacggtgaacaaaggtgttgcgatctgtaaagaaaacagcatcgatttcttattggccgtcggcggcggaagtgtcattgactgcacgaaagccatcgcggcgggcgctaaatatgacggcgacgcgtgggatatcgtcacgaaaaaacaccagccgaaagaagcgctgccgttcggaacagtgctgacacttgcggcgaccggttcagagatgaactccggatcagtcatcacaaactgggagacacaagagaaatacggatgggggagcccgctcgtttaccctaaattctctattctcgatccggtaaacacatttaccgttccgaaagaccacaccatttacggcatggtcgatatgatgagccatgtgtttgaacaatatttccaccacacgtcaaacacgccgtatcaggaccggatgtgtgaatcgcttctgcgcacggtgattgaaacagcgccgaagctgatcaacgatctggagaactatgagcttcgtgagacgattttatatacaggcacgatcgcattaaacggaatgctgtcaatgggcgcaagaggggattgggccacacacaacatcgagcatgcggtatcagcggtatacgatataccgcacgccggaggtttagcgattctgttcccgaactggatgagacatgtgctcaaagaaaatccggcccgctttaaacagcttgccgtccgtgttttcgatattgacgagacaggcaaatcagatgaagagatcgcacttgaaggaatcagcaggctgtctgaattctggacgagcctcggcgctccgaacagactcgctgattacgatatttctgatgagaagctggatacgattgcagataaagcgatggcaaacggagcattcggacagttcaagtcactgcagaaagaagatgtgcttgcgatactgaaagcatcattgtaataacataaaggggggcggccggattggcagctcctttttttctgtgttatagtaattcccttacgatttttttggaggtcatgataaatggagaactttacgtactgcaatccgacgaaactgattttcggaaaaggtcaaatcgaccaattgaaaaaagagctgaagcaatacgggaaaaacgtgctgcttgtttacggaggcggcagcattaagcgaaacggcctgtatgaccaagtaacaggcattttaaaagaagaaggcgcagccgttcatgaacttgcgggcgttgaaccgaacccgcgtctggaaacggtaaataaaggaattgagctgtgcagacagcatgagattgatttccttctcgcagtcggcggcggaagtgtcatcgactgtacaaaagcgattgcggccggtgcgaaatatgacggcgacgcatgggacatttacagcaaaaaagtaacggcgcaggacgcgctcccgttcggcacggtgctgacgcttgcggcgacaggctctgaaatgaaccctgattccgttatcacaaattgggaaacaaacgaaaaattcgtatggggcagcaatgtcactcatccgcgtttctccattttagatcccgagaatactttcagcgttccggaaaaccaaaccgtatacggcatggtggatatgatgagccacgtatttgaacaatacttccacaatgttgaaaacacgccgcttcaggacagaatgtgttttgcggtccttcagacggtaattgaaacagcgccgaaacttttggaagaccttgagaactataagcaccgcgaaacgattttatacgcgggtacgatcgcattaaacggcacgctgcaaatgggctatttcggcgattgggcttcccatacgatggagcacgccgtatcagcggtttatgacatccctcacgcgggaggacttgcgattctgttcccgaactggatgagatacacgcttgatacaaatgtggaccgttttaaaaacctcatgcttaatatgtttgacattgatactgaaggcaaaacggataaagaaattgcgcttgaagggatcgataaattgtccgcgttctggacaagcctcggcgcaccgtcccgccttgcggattatgacatcggcgaagacaagcttgagctgatcgcagacatcgccgcaaaagaaatggaatacggcggattcggcaatttccaaaaactgaacaaagatgatgtacttgccatcttaaaggcgtcactgtaagatacattcccggccggagtgattttcaagctgcagatgtaaccgttttgggagtccctctttccggattttctattagttcattaggagcaagtgaaacacccttttccatgagacaactatggaaatcgtttcatccgtaaaggaccaattaactttgcgattgtctgtcatctatttacacgaaatctaaatcacgaagatgaagagccgcgaatttaaaaaaggggcgctgattcaatcagcgctcctttttatgcattttgtgtactaaggtcccgctgcgcccccatatagcttcccattaagttttgataaccgggaagatgactggagactaatgcgccaaaaccttcaacatcgttgcgccaatcacgctgaagctcgcatgctgtgctgaaccagttcataagctgcacgccgccatgagccatacgggttaatgatgcatctgctacttgcttattaaacgtccccgaagcatctgtcacaacaaacacttcgtagcctgctttaatggcagaaagcgcaggaaaagcaacgcagacgtctgttaccacccccgcgataatcagctgttttttgccggtcgcttcaatggctttaacaaagtcttcattgtcccatgcattaatttgtccgggacgggctatttttggcgcatcaggaaagagatcaacgagttcttgcatgagcggtccgttgggtccattttcaaagctggttgttaaaataaccggtaaatcaaagaatttagccgtatcaccgagagccaatacattgtttttaaattcatcaacgccatagtcacgcacgagaccggaaataaggccggtttgatggtcaactaaaagcacggcagaatcatcttttgaaagacgggaataaagatcagacattttatcatcctccttgaattaaggcaagtcagtttgtcaatggaaaacggtaaatctattcatatactgtataggtagaaagttatttctgaagtgacttttcgtgaaggtgatgatctttcaattaatccggaatgggaaccggagcatgatcaatccaatggatgaactgttgtaaatagcgttgaagataacgttttgtttgttcatccgtaagtatgtgttgagcggaatcaattttctcatggacttgcgaaatcagcattttttgaaagggcagaacattgacttgcatagcttcgagtacttctctcgtttgcatttgaccaaaagaggtgccgaaccctccgggggttgcgccgattaagccaaccggttttctgtttaaaacggaagaggtccgcggtcacgatgcccagtccaatgcattttttaatacccccgggattccggaattgtactctggacttacaatgatgacgccgtcaacgtctcgtatatcagctctaaaggatgttacggagtctggtgctccggccatttctaaatcttcgttaaaaaaaggaagagtgtctatttcaacccagcgaaattgagccgcattatcgaagtcaatcaatgattgagcaatcactcgattatacgagttttttcgtaaacttccacaaataagaccaatggttttagtcaaagaatcacctcccggtttaaaattattttcatcttaacatgataacccaaatatagacactatttttaaaaatggacatttataccttaatatgcctgcttagcagcctctcaagaggagtactatataaaaagaaccgtcccatcggtattggcgatggatgtcaacctgctccaaagtaaaggtgatacgttcctggatcaccaacattcgattcgttacctctttcacgattattacaaatataactatttcgaatccgggatattgtataaaaaatgagcgcatcttcagcgcaaatcccgtattcatcatgccttcttcatgacttgatttagcgggtgagttcatataaagtgaaagagaaaacaattcaccgtgatggagggacaagcaaatgacgcatgtacgctttgattactcaagagcgttaccttttttcaatgaacatgaacttacatacgcacgtgatttcgtaaaaacggcacaccataatatccatgaaaaaacaggcgccggaagcgactttttaggctgggtggacctccctgaaaactatgataaagaagaattcgcgcgcattaaaaaaagcgctgaaaaaatcaaatcagattctgacgtgcttctcgtcgtgggtatcggcggttcatacttaggcgcccgcgcggcgattgaagcgctcaatcattctttctataatgttctgccgaaagataagcgcaaaaaccctcaagttatctttatcggcaataatatcagctcaacttatatgaaagatgttatggatcttttggaagacgctgatttctctatcaatgtcatttctaagtcaggcacgacgacggaacctgcaatcgctttccggattttccgcaaacttcttgaagaaaaatacggaaaagaagaagcgaaagcgcggatttacgcgacaacagataaagaacgcggcgctttaaaaacgctttctaatgaagaaggcttcgaatcattcgttattcctgatgatgtcggcggacgtttctccgttctgactgcggtaggccttctgccgattgcggtaagcggggctgatatcgatgaaatgatgaaaggcgctcttgatgcaagcaaagacttttccagctcggaattagaagagaacgcggcttaccaatacgccgtcgtccgcaacgttctgtataataaaggcagaaccattgaaatgctcatcaactatgagcctgcgctgcaatactttgctgaatggtggaagcagctcttcggcgaaagtgaaggaaaagacgaaaaaggcatctatccttcttccgctaacttctcaacagaccttcactctctcggtcaatacgtgcaggaaggcagacgtgatctgtttgaaaccgtattaaacgttgaaaaaccgaagcatgagctgacaattgaagaagcggaaaatgatctcgacggcttaaattatttagccggcaaaacggtcgatttcgtcaacaaaaaagcgttcgaaggcacgatgcttgcccatacagacggaaaagtgcctaacttaattgtcaatattccggagcttaacgcatatacatttggatatctcgtttatttctttgaaaaagcggtggcgatgagcggttatctgctcggagtcaacccgtttgatcagccgggtgttgaagcctataaggtgaatatgttcgcgcttctcggcaaaccgggctttgaagagaaaaaagcagagcttgaaaaacgccttgaaaaataaaaagaagggctggccctcagcatgacgggtcagccttttttaaaccgtgaaaggtgtgatgatgaattgatgcggcttttatgtaagcatgtcttcatttccgtctgttccgccgctatcgtctattcggcactaaaactgtctcccgaatccctcttgcaaaccatcctgtttttcgctttccctctcggcttgtttacggacatggtccggctgaaactgaagattggccggatgcatacgctgatcacgaagtgctgtctctatgccgccgttttctatatttcaacggaagccgctctctccgcaattgtgacgtatgttctgattgaatgcgccgtcacctcttttcagcgtctgtctgccgctcccggttcttcccggacgccgtatgaagataccgcagagcggggacgctaaagacaaaaaggagcatatgcacatgatcagcataccatcttcacttgaaggtcaatcgtttttactccgcgaactggaacaggtgatgaaaccgatcggttataccatcggaggcggctgggagtatgaccgcgggttctttgattacaaaatttccgatcaggacggctatttatttctccgtatccctgttgaagcaaataagggacacctggatgaacggggggccgccgttacaatcggcacaccctttttgctgaggcacgtttatcagcaggaaacggatgatgcagcaggcggcggtgtttttgagtcattattcaaccaattctccgaaccgaaacggcgggatgcggcaattgaccgctcatatacagatatcggcatctcgcttgtgaaagagctggaagacgtcctgctgcattaaagagccaaaaacagatcagtatcgagcacctggtatgacaggggaggggtcagcatcggcccctcttctttttgtatgccgatgatcgtggtattccgtctgagataatagagcgcgcagtcatgataagatgagccctttagttcctcggggacgggaatgatgcgcacctttttctccagcgtcagatctgacagcgtttgcggtttggcaagctgcagcttgacccggtaatgctcaaacatcacccggctcgacaggtgtgatgtgcacagaatcttattggctcctgcgcgctcggcgtttttgacataccgttccgttaaaatttctacgatacaataaacagacggatgcagccctttgatggcgagaagcgttaataccgacagcatatcagcttcggattcatttttctgctggtccgctgtcagaatgacggtatcagcttccgtaatattcgccttattgagcgtgctgtcatcagcggcatgtccgcggatgaaatggacgttttcaataagcggaccttcccttaatgaatcatcaatcaggacgacagtttttgacggtgcgatgtgctgcagctctttcagcagcatatgcgatttttcgttccatccgataagaatgacgtgccccttgcctttaaaggcgaccttcccttcgacatagcggtgctgtttgctgaacacggctgaagaaagcgtggcgaaataggcggtcacaaaactcgctccgcttaatacaagcaccatgccggcaatctgcccgagcggcgtctgcggaacgtaatcgccgtagccgactgtggccaccgtaatgaccgcccaccaaaccccttcaaacacagacgtgaattgcttcggttcgagcatgtaaatgagttggccgaacaataaaatcaaggcgataatgatcagcccgatccgaacatataacggccatctcagccaggaaataaaaatacggtttgatttcattcgtccggctcttctttcgacagagagatggataaaatctgcttaataatggtgtttagtttttcgtccagctgttcctggccgtatgagtcacgcgcatgtctgattaaatcggccgtctcatcttcaaactgaatgagaggttcgtcgttttctgattcattatagagctggatgaaggcgtcaagcccttcgttcattctgtctatcgcattgctcagctgttctttctcgccatttgtcactttcatgtcgatcacacctgtatctttttttatacagtatgtcccagttcgtttgatgtctttcaaaaatcgccgaaaacatattcacccttattttttcatatgataaagaaagcggaccgaaaaagggtgagtcaaatgacggtcattcaaaaactgttggcggcgctggccggagcgcagctgcttgcttcggcggccgtattgcttattttcgatttgaatggatacaatcacatgtccggcggattttcatggcttgtttttgcaaaagagaccgcaggcacgtttccgttttacatcggaatggccgggtgtatcctcatcatgctcggaggattgattcctgtcagaaaaaagaagcggatttctgtacaggaaagcgggcaatcattaaaataatatataagcagatcgtacgatataagagaaaaaggaagaggataatatgctgtttatctttttaacaattgctgcattgggtttgtcgttttgggcacaatttaaagtgaaaagcaattttcagaaatactcagacgtggaagcctccagtcagcggacgggggcggaaacggcaagacggattcttgatattaacggtttatatgatgtgccggtagaaccggtaagaggcactttaacagaccattacgacccgacggagcgggtggtgcgtttatctgagccggtatattacggccgctccatttccgccatttccgtcgcttcccatgaagtcggacatgctttgcagcatcaggaatcatacggcgcgcttgtgctgaggcacaaaatttttccggtcgtcaattttgcctccggggtcgcccctctgcttttcttgggcgggatgctcctgggcagcttgaacttaatcggactcggcattattttgttttcggccgctgtttttttccagcttgtcacactgcctgtcgagtttaatgccagcgcgagggcgaagcggattatcgtgtcggaaggattcattcgcaacagtgaagaacacggcgtgaataaagtgctgaacgccgccgcgctgacgtatgtggctgcggcgctcgtttcattattcgagctgcttcgttttgtgatgattttcttaaatggtcgtgatgagaattaacacgaaggaggtggccccttaccgtttgcggtaggggtttttttgcttatattaaaactgattctcattatgctgttaatcggattaacggccatctttgtcgctgcggaatttgcgattgtcaaaatccgcggttcaaaaatcgcggagctggttgaaaccggagacagccgggcgctcgcggcgcacagggtgatttcaaatctcgatgaatatttatcagcgtgccagctcggcattacgattacggcgctcggactcggctggctcggtgaaccgacgattcagcggcttcttcatcctgttttcagcctgatcggaatgccgtcatctattacgcacgtcgtcacgtttattgcggcgtttatcgccgtcacgtatctgcacgtcgtcatcggagagcttgcgccgaaaacgatatccattcaaaaagccgaagctgtcagtctgtggacggcgaaaccgctcattctgttttataaagtgatgtatccgtttattaagctgttaaacggctcagccggatttttggtcaagctgttcggttttcattcggtgaaagaacatgaggtcgtggtcagtgaagaagaattgcggctgattttgtccgaaagctataaaaaaggtcaaatcaatcaatctgaattccgttacgtcaataaaatatttgaattcgataaccgggtcgccagagaaatcatggtgccgcgcaccgaaatcgccgtcatctcgcttgaacagtcagttgatgaagccatacatttgatcatcaacgaacggtatacgcgatatccggttattaaggaagacaaagatcacattctcggcattattaacaataaggatttatttaaagcgtattttctcggccgctccattgaattaaaagaaatgatgcgtccggtcatcagagtcattgaaagcatccccgttcaggagcttttgatccgcatgcagaaggagcggattcatatggcgattctcgttgacgaatacggcggcacggcgggacttgtgaccgtcgaagacatattggaggaaatcgtcggggaaatccgtgatgaatatgaccaggatgaaatgccccacatcgtcaaaaaaggcgaacaccattatgtgatggacggcaaggcgctcatagaagaggtgaatgatctccttgatatcgccatcgaaaatgaagacattgacacgattgccggctggctcttaacacaaaaaatggagctgaaaaatggtgatgtgtttcatgccgaagggtgtgaatttaaggtgctggaagcggaagaccatcatatccgcttcgttgagattaaaaaaactgatttctgagcctcctgcttttgcaatgaggctttttttatggaaaaaatgcttcttcgtcccgctccttcatatgctgtaaagaaaggagtgtcggtatgaaaacggattggtggaaaacggcggccgtctatcaaatttatccccgaagctttatggattcgaacggggacggaatcggcgatattaacggcatcagagcaaagcttcattacataaaagagttgggggcggatgtgatctggctttgtcccgtttttgactcgccgggcgcggacaacggctacgatattcggaattataaacaaattgccggcgaattcgggacgatgaaggattttgaccggctccttgcggatgtccatgcgctcggcatgaagctgattatagacctcgtcattaaccatacaagcgatgagcacccttggtttatcgaatcacgctcagcgaaagattccgaaaaacgggactggtacatctggagagacggaaaaaacggcaaagagccgaataattgggaaagcattttcggcggatcggcgtgggaatatgatcaagagaccggccagtattacctgcacctgtttgacaaaaaacagcctgatttaaattgggaaaacgaagcgatgaggcagtccgtttatgagatggttcgctggtggcttgataaaggcatagacggcttccgggtggatgccatttctcacattaagaaaaaagaagggctccctgacatgccgaacccggacggtctcccgtacgtcccgtctttcccgtatcatatgaatggggaaggcataatggatctcttaaaagagctgaagcgggaaacattttcgcgctatccgatcatgacggtcggcgaggcgaacggagtggcggcttgggaggcggctgattgggccggtgaagaaaacggcgtctttcaaatgatttttcaatttgaacatctcggcctctgggatacggaagatgatcaaagcatctccattccggcgcttaagcgcgtcttgtccggctggcagtacagccttgaaggaaagggctggaatgcgttatttatggaaaatcacgaccagccccgttccgtttcggtatggggtgacgaacggtttttgacagaaagcgccaaggcactcgccgtgatgtatatgctgatgaaaggcacgccgtttatttaccagggacaggagctcggcatgaccaatgtttcgttcccatccattgaagattatgatgacgccgcaattaaatatctgtatgaaaaagagacgtcccgcggcgttccgcatgaacaagtgatgaagatcatctggaagaagggccgggataattcacggacaccgatgcaatggagcggtgaggcgaacggcgggttttctgatgcttctccgtggctcggagtgaatccgaaccacacatggctgaacgctgcatcacaattgcaggatgaaacatccgtataccatttctacaaacggctgctcgccctcagaaaaaaacacggcgtattgatcagcggcacatatgaattgctgcttccgaatgaccggcagatttatgcctatctaagaaaaaacggaacaaaaaccgccctgatcatcaccaatctgtcccgaacccccgctttatacaggcatcccggttatccgcttgactccgattctctcgtgcttgcaaacgtggaaacagaatcgcaccgccatgtgacatccttcctcttaaagccttatgaggcccgcgtatatatatggtgaaaaacttcagtcccgaggctgaagttttttgtgatctgtgtttatcatcgcgatccgacaggaaaagacaaatacagaaacgaatatgggaaaggaagagaaaaagaaaggaggcattcatatgctgaaaaaattgcagattcaaacaaacaaaagggatgaaatgatcgacatcacacatgaagccgaatcgtttctccgcgaaacaggcgtaagaaacggtttggcgctcatatactgtccccataccaccgccggcattaccatcaatgaaaatgccgacccggatgtgaagagggatatgctcagaaggtttgatgaaatgtatccgtgggagcacgaactggaccggcatatggagggaaatacggcggcacatatgaaagcgagtacaaccggcgcctctcagcatgtcatcatagaagacgggcgcctgatactcggaacatggcagggcgtttatttttgcgaatttgacggtccgcgaaacagaacatgttatatcaaaatactggctgaaacggaggaaaacaaatgagtgagtggatgagtccgttatcattaacaaagcccgtcattcaggccccgatggccggcggactggtcacgccgcgtctggcttcggcggtatcaaatgaaggggcgctcggaagcctcgcttcaggatacgtcagcccgcaagcgcttgaaaaacagcttatcgagatgaaagagctgacggaccgctcctttcaagtaaatcttttcgtcccggaagaaagacagatgcctgaggcggaacttgttgaaaaatggaaagcccgcattccgagggcaaaagacgccaagccgttctctgatctgaaagaagaatggaatgatttcgcggaaaaagcggagcttctgatccgttacggagtcaaagcgtgttcattcaccttcggcctgccgccggaaaaaacggcggaaaagctgaagaaaagcggttgtttccttttcggcacggcgacaacgccggaggaagcgaaggcttttgaagaacggggaatggacgccgttatccttcagggaatagaagccggcgggcatcgcgggtcgtttctgccggttaaaggagaaccggctctcggccttatggcgctgattccgcaggctaaagacacgctgaatatcccggtgattgcggcaggcggcatttttgaccgccgcggggtgcaggcggcccgatgtttgggtgcggacggcgttcaagtaggaacaccgtttctcctttgtgaagaaagcagcgcctcaccggcatatcaaaaagccattgccgaatcaaaaggagccgatacgcggctgaccaccctgttttcaggaaaacaggcgcggggaatcgtgaatcagttcatgaaaacatatgaagctgacgagggaaaaacgctgccttatccgctgcataatacgctgacaaagccgatgcgcgggcacgcggctcaatcaggagacgcggagcatatgtctttatgggccggccagtccgccgcgaaacttgaggggccgacagacgtgaaaaccgttttggacagattgtgcgaatcataatccagaaatcgtgaggtgatggatgatgaagattcttcaaatgtcctataaaaaaagagggactattgagtttgtctttgaagattttccgcattccaaagtcaccatggcgccgattaaagggtattactttgtccgcgccattaaatggagcagacgggacagagccgtcacccgccatgatttagagaagtttgaatgggctgcaaaccaagcgctcggcacgacggctttttaccggaaaagaaaagcatttcacatcccatcgtcacaatgacagacgatgggattgttttaatgcatgatctgataaagcgcgggtgcatcaagccttgttgcctggttaagcagataagccggctgcacggcatttttttttcttaaagaattcaatctctggatgatttgttcagcggtcagaatcccgagaccgtgggcgaaatattgatcattccccatcacaatgacattttctccccgccactgagcctttgcagggttaaaatcaggatttttaaaatataaacagtctccccgtaaaaagtggctgccggtttccgtgtagatcggcagatgctcatagtgccagtcatacaaagtgatatcccggaaacgccggttaaaccgttcttcaccgattgtctttaagacggccagataataaatcacaacaatggcggtagcgcattcaaatgcgtaaaacgccccgttttcaataatatcccgaatcgcttttgaagcgggaatcctgtacttcagctccagggctccttccggcgtcagtctccaataagccgtatttccgtatgttttggcgaaagttgcaaatttcacacctgatccgtgcagttctcttgcggcttccacaatatggcggcgcagccgcacctcgaacatcagttcagcaatcgacccgtaatcgaattgtacgggagaattgagcagttcatttatatacggaacaaggctttcttccgtctgccagttcgcgatgtcctgaggccgaagcacttggccggatatgataatcatctgcgcgccccctatctttttttataagatatgcaggaagcttgggcaatgaaaatcaagtgataaaaaaggaggaaatgttaacaaaatgtgaagactgagccgatatataaggtatcacacttgagggagcagcttaatatgaaaaaattcattaattggtgcacaaaggcatcgatttcacggaaattaatcatttcatttatcgtgatcttaatcataccgattctcgtgttagaattcagttcataccatacggcgagcaattcgctggatgatcagatttcaggcaacgcgaaaaataacatcgaatcttttaacacaacgattacaaatgatatcggcgcaaaagcaaaggcgattgaatttttcagtgaaacgttaaaaggatcatccttctcaaagaaaaacatgtctgctcttgaagaaaagttcgggcaatacacgtctattcataaggacgtagcccgcatttacggaggaacggaagacggcagctacgcacaggcgccgaaggaaaatactccggccgattacgatccgagaacacgcacttggtataaagacgctgtgaaggccggcggcacgctcgttgtcaccgacccttacaccgcggcaagcgacggcagcatggtcattaccgtggcaaagcagatgcaggacggaacaggcgtagtggccatggatattacgattgaccagctgctgaagcagatgcagggaatcaaaatcgggcaaaaaggattcgtgtttatcacgtccaaaaataaaacctatgtcgcgcataaagaccacaaaccgggcgataaagtttcaacgccgtggctgaatgaggtatacagcaaagacagcggcattatttcatacaagctcgatgatcaaaataaaaaaatggcgtttacgacaaataaactgaccgggtggaaaatagaggggagcatggagctcaacgaaattaaagatgcctcacaaccggtgctgacgatggggatgattgtccttgcagcatctattatcatcgggggaattttaattctgttgattgtcagatccattacgtcaccgctgaaacggcttgtccgctcttctaaacaaatcagcggcggagacttgactgaaaccattgacatccgctcgaaagatgaattgggcgaactcggcgcgagctttaatgaaatgggagaatctttgcgcggactgatcagcgcgatccaaaactctgtcgataacgtggccgcgtcatcggaagagctgaccgcttcagcttctcagacaagcaaagcgacggaacatattacaatggcgattgagcagttttcaaacgggaacgaagagcaaagcgaaaaagtcgattcaagctcagccaagctgaatcatataaatgacggactcgccgccgtttcccgcacatcatcatccattacggaggcatctaaacaatcgaaggaagctgccggcaccggggaagaatatgtgcagcaaaccgtcgggcagatgaatctcatcaatcaatcggtccagcaggcggaagcggttgtaaaaggccttgaggccaaatcaaaagacattactcatattttaagagtcatcaacggtattgccgatcagacaaacctgcttgcattaaatgcagccattgaagcggcaagagccggtgaatacgggcggggcttctcagtagtagccgaagaagtgagaaagcttgccgtccaatccgccggttctgccaaagagattgaaaaactcattcaggaaatcacggctgaaattaatacttcgcttcacatgtttacatccgttaatgaagaagtgcaatcaggacttgccgtaacggatcgcacgaaagaaagcttccagaatatcttcggcatgacgaacgacatcgccgaaaaactgcaatcaatgaacggcacggttgaacagctgtcagacagctctcagcacgtttcagccgcagtgaccgatattgcggacgtatcacgggaaagcgcagcaagcattcaggatattgccgcatccgcagaagaacagcttgcatcaatggaagaaatcagcacatccgccgatactttggcgcaaatggccgaagaactgcgggaattaacgaaacaatttaaaatcaactagtaaaaaaggacgctttccaggtggaaggcgtccttttttatagtgacagccggataattaaataaaaagtcttgcatacaaagggagtacatagaactatttttcatttatgacttaattttcaatgtaataaaaagggagtcggccgatataaacagtaaatgattgaaagaggtttacaaaattgaaaaaaacagcaaaaaaaatcgccagaaaatcaatagccaaaaaacttatcatttcatttttactgatcttaattattccggtagcagtattggccgccggcgcctaccgttcggcggcttcatccgttgaaaagcaaatgatggaaagcgccgaaggaaatgtgcaaatcttaaacaatatgattgatgaccggatcggaatgtttacaaaaagctctgcatatttcagcgaatgggcgacaagcgctaaatttaaagaaaaaaaccaaacggaaatgcaagaaaggtttaaacagtttattgaaagcaatgataaagcgtccgccatattttcaagcagcaaggaaggaacgtttacccgttatccgcatgccgatatgccggccgatttcaatccgcttgaaagaagctggtatcaggaagccatggagaataaaggccaaaccatcatcacggacccttatgagtccatctcaaacaaaaagatggtcgtcaccatggcccgcgcggcgcaagacggatcaggcgtcgtcgccattgatataaaaatcgacgatctcatcacgatgacaaaagaagtgaacatcggaaaagaaggatacgcctttatcctcagcaaaaataaaaaagccgttgcctacagtgatgaaaaagccggcgcggcggtatcgggaaaatgggttgatacattatacagcgggcaaaaaggcgactatgaatatacgctgaacgggaaagcgaaaaaaatggcgtacgtgaccaatgaagcgacgggctggaagatcagcggaaccatgtccgtggatgaaatcaaggatgcggcaagaccggttctgactctggccgttatcatattggcgatagccgttgccgcagggatgattttcatttattttgtcatccgctcaattaccaaaccgttaaaacgtctcgtagcttcagcggaaaaaatcagcagcggagatctgactgaaaccattgatgtcagctctcaagatgagctcggcgtgctcggtaaaagttttaatcatatgacagattcactccgttcgcttattcagggaattcaggactctgttgaacatgtcgcttcttcctcagaggagctgacggcttcggctgagcagacgagcaaagcaacggaacatatcacccttgcgattgaacagttttctaatggaacggaagaccaaagtgagagtattgataaagcgacagcacaagtgaatgagatgaaagacgggctcagcgatctggcggaagcggcagccgttgtgacggaaacttcaattgaatcggcggagatatccggcgccggtgagcggcttgtcaagaaaacagccggccagatgggcgccattgaccaatccgtaagtaaagcggagcaagtcgtacaagggcttgaactcaaatcgcaggacatcaccagcattttgcgcgtcattaacggcattgccgatcaaacgaatctccttgctttaaatgcagccattgaagcggcaagagcgggagaatacggacgcggtttttcagttgttgccgaagaagtgagaaagcttgccgtccaatccgccgattcagcgaaagaaatcgaatccttaattcatgaaatcgtcaaagaaattcatacttcgctcggaatgctggaatccgtcaatcacgaggtgaaaagcggacttcagttaacggacgaaacggaaaaaagcttccgggacatttccgctaaaacaagtcagattgccggtgaactgcaaaatatgaatgcaaccgtggaacagctttctgccggatctcaggaagtatcaaacgcttcagaggatatcgcggcagtctccagacaaagcgcggccggcattcaggacatcgcggcttcagctgaagagcagcttgcgtccatggaggagatcagttcctcagccgtcacgctggaaaaaatggcggaagaattacgcgaactgacaaagcgttttaagataaactcttaattaagtctaaaagactaattttgcaataggtaaaaagtatgtttcgttatatttcttctttttggatgtgtatatttacccataattgccgatatgaagggtaaacacgcaagaggagatatagcagatgaaaaaaattgtgcaaatcatcaagcagagatcgcttacaagaaaactgctcatttcttttttggccattctcattcttcctatttcaacgctggcttttatcgcctatcaatcggcggtaagtacgcttgacaggcagatgatgggaagcgcattagataatgtgcagcagattaacgatatgatcaacacaagcatcagccaaaaggaagacggaacggcatatttcagcgactggctcacaaaggatcggtacaagccgaaaaaccaatcgcaaattaccgataaattcacagagtacatgaagattaataaagacgtggaatccatctatacgagtgacacggaaggacatttcacacggtatccggatctgcagatgcctaaaggatataatccgcttgaaagagactggtataaaaaggccgtggaaaataaggggaaagttgttgtaacagatccttaccgcacggcttccaccaatacgatggtcgtgacggtcgttcagcagacgaaagacggctcaggggtcgtcgccatcaatatgaaaatcgatgagcttctgaaaacgacaaagaaagtgaacatcggaaaatcaggctacgcttttatcctgacgaaagacaaaaaagtggtcgcccacccgaaccgtgcgtcaggcacagtattaaacggggagtgggctgaacagttgttcaccagcaaaaaaggtgattttcaatacaaatacgacggccaggaaaagaaaatggcttatgatacgaacgggctgacaggctggaagattaccggaacgatgtatctggacgaaattcatgaagcggccctgccgatccttcatctgtccctgctcgttctcgtattagcgattgtcatcggaaccatcgtcatggtgctgattatccgttcaatcacaaaaccgctcaagcagcttgtgacatcatcgaaacagatcagtgaaggcgacttaacagaaacgatcgaaattcagtcaaaagatgaattaggcgagctgggcaaaagctttaacaatatggccgcttcactcaggtctctcatccatgccattcaggattccgtgaataacgtcgcatcttcctcagaagagctgacggcttcagcggagcagacaagcaaggcaacggaacatatcacactggcgatcgaacaattttctaacggaaatgaaagccaaagtgaaaatatcgaaagcgcggcggaacatatttatcaaatgaacagcgggcttaaagatatggcgaaagcatctgccgtcattaccgaatcctccgccacatcagcggaagtcgccaattcaggcggaaagctcgtccaccagacggtcggccaaatgaacgtcattgaccggtcagtgaaagaagctgaacaagtggtgcgcggacttgaaacaaaatcaaaagacattacaaacattctcggtgtcattaacggaatcgctgatcagacaaaccttcttgcgctgaacgcggcaattgaagccgcgcgtgcgggtgaatacggccggggcttctcagtcgtcgccgaagaggtcagaaaacttgcggtccagtctgccgattcagcgaaagaaatcgaaagcttaattatagaaatcgtcaacgaaatcaatacatctctcggcatgttccaatccgtcaacaaagaggtggagagcggactggatattacgaatcagaccgaaacgagcttcaaacggatttctgaaatgacgaaccagatcgccggagaaattcaaaatatgaatgcgacggtagaacagctgacagcaggatcacagcagatttcaggagcttctgagcaaatcgcgtccatcgcaaaagaaagctccgccagcattcaggatatcgcggcctctgccgaagaacagctggcttcaatggaagaaatcagttcgtcttcggaaacgttatcccaaatggcggaagaattacgtgatatgacgaaacgatttaaaatagattaatagatcatagaacacccaaatgtgctgtttgggtgttttttttagtttttttaataaatcttttgtcctatctgacgatattagatttagcttttcaaagaaggagactgaaaaaatgaaacaactgatacattggatcaaacagccatccatcagcaagccgctgatcgcggcatttttagccgtattggtgcttccggtcggcatactcgcctacttcagctaccaaacggcggggagtacattagaaagcgaactgacccacagcgcccagggaaatgtcagtgaactgaacagcgtgctggaaaacatgcttgagggtaagctgaaagcgattgactactacagcgaatcaatcacaaaggaaaaactgaacacgaaaaataaatcggtactgctcgacaatatgaagcagtatgtcaccgtaaatggcgatgtcgcgtcaatttacgccgcgtctcgcgacaaagcgtttgtgaaatatccgtccgctgacatgccgtccgattataatccgctcacgcgcgagtggtatacaaaggcggttgaaaaaagcggacagccggtgtttaccgagccttataaagacgctgcaaccggacagacggtcgttacgattgcccagcagacaaaagacggatcaggcgttgtggcgcttgatattaatctgggcgacctgctgaacgcttccgaacgcgtccagatcggtcataaaggatttgccttcattacaacgggggataaaaaatacatcgcccatccgactataaaagcgggaacggaaggctccggagagtggacgaaagaagtattttccaaatcaagcggatcgtttgaatacatgtttgaaggacagcagaagaaaatggctttcacgacaaacaaactgacgggctggaaaatcgccggcacattttttgtcagtgagatccatgacgcagcctcgcctgtcatgaaaatggcgctgatcatcctggcggtttctcttatcgtcggcggtattttaatcttctttatcattcgctcgattgcaaaaccgctcaaaaaacttgtctcgacatcagataaaatcagtgacggcgatttaacggaagtcattgacatcaagtcaaaaaatgaattcgggcagctcagccaaagcttcaatgagatgtcggcatcactccggtctgtcatcggcgtcatccaatcatccgtcgaacatgtcgcttcttcatccgaagagctgacggcatccgccggacagacaagcaaggcgacagagcatattactctggcgattgaacaattctcaaacggaaacgaatcacaaagcgagaaattggaagaaagtgctgatcacctttcccaaatgaatgcgggcattgccgagacggcgaatgtatcggcggaaatcactgaatccgccatccaaacctctgaaacggccggaagcggagaagaattagtggcgaaaacggtcggccagatgaaaacaattgatcgttccgtacagcaggcggaagccgtcgtaaaagggctggaaacgaagtcgcacgacattaagagcattctgaacgttattaacggcattgccgatcaaacaaatctgcttgccttaaacgcggccattgaagcggcaagagcaggcgaatacgggcggggcttctccgtcgttgcggaagaagtgaggaagcttgccgtacaatcagccggctccgcaaaggaaatcgaaacgctgattcaggaaatcgtcaaagaaatcgccacatcgctttccgtattccaagcggtgaatcaagatgtgaaggaaggcctcgatattacggatcaaacggccgaaagcttcaaaaaaatctcagagatgacgactcagatttcaggcgccttgcagcatatgaacggaacgcttgagcagcttgcagccgggtcgcaaaatgtgacaaacgcggtggaggacattacctcagtcgccaaagaagggtccgccggcattcaagacatcgccgcctcagctgaagagcagctggcctccatggaagaaatcagttcatccgccgaaacgcttgcgcatatggctgaagaactgcaacaggtcacacggaaatttacgattcagtctgaagacgaagaacagctgtaacgagctgtttcttttcctcatctgaaaaaagcgatacactaatataaaagaagggagtggcagtgatgagattagaaggcaaaaaagttatagcgcttgtcagtgacgattttgaagacttagagctttggtatcccgtctatcggctgagagaggaaggcgcgatcgttcatttaataggagaagaagcgggccgttcatacaaaggaaaatacggcgtgcccgcgacggcggattacgattttaagagcctgattattcaggagtatgatgccgtgctcgtgcctggcggctgggctcctgacaaactgcgaagatatcccgaagttttggacatcatccgtacgatgaacgagcagaaaaagccgatcggccagatctgccatgcgggctgggtgcttatatctgccggaattctcgcaggaaaaaaagtaacgagcacgcccggcatcaaagacgacatgacaaatgcaggggcaaagtggctggatgaagctgtcgtaactgacggccacattgtatcaagccgccgcccgcccgaccttccgcagtatgcaaaagcgtttgctgacctgttagcgtccaaataaaaaacatccgcccgaatccgggcggatgtttttagttttgatcggcgggaaagacgattccgatttgttttctcgcttcttccataatgtttgccgtaatgaaagaacgttcaaatgtattttcggaagactcccgctgtccgtttcgaagaagattgatgaattcagccgtttcgtagtacatcgaaggtttcagatcagggactgaaatgtcttccgtccggccgtcacgatagcggatttccgcccgttccggtccgtgaatgctgtccagaacgatcgtgccttcttcaccctgaatttccgccggggcaaacgaatttgagattttcgaatgcatcagcaccgcttcaaatccgtcgtatgacagaatgaccgtgccttcgccgtcaacgccggatgctagtttatgaccggtcgcaatgacgtttttcggtttgccgaacaggacgacggccggataaatgcagtacacgccgatgtccattaacgaaccgttcgataattcaggcttaaacgcgttaagcaccgtaccgtttttatatgcatcatatcgtgatgaatattggcagtagcttgccgtgaatctcctgacgggtccgattttatgtaagtggttttgaagcatgctgaagttcggcaggaacgtcgttttcatggcttccatcaagagaacgccgttcgttttggctgcgtgaatcatttcatccgtttcccttgcgttagacgcaaacggtttttcgcatagtacatgcttgccgtgttccataaaaaggaccgcctgctctttgtgaaatgcattcgggctggcgagatacaccgcgtcataggctttgctttccgccatttctttcaggctggtgaaataatgagcagcgccgtgtttgccggcgaattccgccgcacgttcctcagttctggaataaaccgccgttaattgaaaatcatcaatagcagaagccgcctccagaaatcgttctgtaatccaattcgttccgactgttgcaaatcgaatcattgctatcgctccttctatgtattggcttacattatagctttttttcaaagaaacataaatggaaaaaaggctgccagctaaacggataggaaaaattcccatagagaccggttattatttttcattacaggaacgatagtgtacaatttaagtaaaatacatatgatggaggaacaatagtggaaacattgcaaacatggggcggcagatttaaacagtttttcttagacaataaatttgtcttgtttttgcttgtattgctgctcatcggtctcaatatccttgtctttatgaagacatcatttattttcacacccattatcgtcctgctcaaaacgattgcgctccccgtcattttgacaggaattgtttattatctgcttaatccgatcgtagatatattggaaaaaataagagtgaaaagagtctattccatcctgctcctttacctcattattatagggctgatttcgattacggtcgtttcaattattccgtttttaaaggaacagatcatgagcctgatcgacaacctgccgaaatatgtggacatcgttgaagatcagacgaaaagcctgatcggaagcgattttgtaaatcaggcgcaaaagacgatgaatatcaacatttcggatcttgccaataaagtatcggcgcaggcggcgacaattgcaaacagcacatttaccggagtcgggaattttatcggcgcgctgactgaagtgattatttcaattgtgaccgtgccgtttattctgttctatttgctgaaagacggcaaaaaactgccgatctatatcttaaagtttgtgcccacccgtctgaaagaacaaacgtatacgatgctgagtgaaatgaaccacagattaagctcctatatcagaggacaggtcatcgtcagcttctgcatcgggtttttattatttatcggctatctgattatcggacttgattatgcgtcactgcttgcggtcattgccgcttgtacgagcgttgttccgtatttagggccgaccattgctatcacgccggcgattattatcgcgttggtcacttcgccctttatgctgctgaagcttgcgattgtctggaccgttgtccagctcgtggaagggaaattaatttcgccgcagatcatggggaaaaatcttcacattcacccgattaccatcatctttgttcttttaaccgccggaaagctgttcggggttgtcggcattattttagccatcccggggtatgcggtcatcaaagtggtcacgacccatctgtttgattggttcaaaatgcgttcgcatttatatgaagaagaaaaaaatgatgctgtatcgaagtcataaaatcggaacggacatgatatttattataagacaggctttccttcaaaggagagcttctcttttgtaaatgatgaatgaagggaagaatgggatgacactatgggagatgttcacagcagccgttttgggaatcgtggaagggctgacggagtacgcgccggtttcttccacgggacatatgatcatagcggatgacatctggctgaaatccggaagcctgatgaatccggaagccgccaattccttcaaagtggtgattcagctcggttcgattctggcggtggccattgtgtttaaggatcggatattacatttactcggcctcaaaaaaaacgtcacgcgcgatcagcagaagggatacaggctgaccatcgcgcaaatcgccgtcggtcttgttccagcggcggtgctcggctttttatttgaggatttcattgaccgctatttattctccgtcagaacggtcgcttacggattaattgccggagccgtgcttatgcttatagcggactggatcaataaaaggaaagaaacgatcgatacggtggacagaatcacctacaaacaggctttctgtgtcggattattccagtgtctcgccttatggcccggattttcccgatcaggctcaacgattgccggaggtgttattgtgggcttgaatcaccgggcagccgcagacttcacatttattatggcgattccgattatggcgggcgcaagccttctgaagctggtgaaatactggagcagtctttcttatgacatgattccgttttttcttgtcggctttatctgcgcctttgtcgtcgccctcttagtcgtcaagttttttcttcggctcattaaccggattaagcttgtcccgttcgccatttaccgtgtcatcctcggcatcattttaatcatgctcgtgcgataaacgaagaggccccccggagggtcttctttttatgttcgaaaaacgtctcaggaaaatatgagcaaactgaattttctgcttgaaattcatagaagagtcgtctataataaaacatgacgttacagcacggggccatagctcagctgggagagcgctacgctggcagcgtagaggtcaggggttcgagcccccttggctccatacctttaaacccttattctataaataagggtttttttgttttttcatcctctgcagcagcctctgtgttccgcttcatttctaacaactcaaaataaaggaaagagagaaaatgaaaaagaaaatctatcttatattatctctgtcagctgcactggcacttcttttaacggcgctcccggctctttctcctgtcatcttcacgtctgcttcagaaaaaggagccatcaggcatgacatttataaaaaaggatatccgtatcaaagctactttgcgattcttcaaaaagaagaaggaggcggagaggacgggaacctttattatgtaaattggttcaattggaaagatgaaaccggacagacgccgcacgtatgttattcaaaaaaatcgtccgaaggcgagtacaaagtaagctgcggaaccggatcgtaatgatcaagagcccctctgcaatgaggggctctttctgtcgatgtggatccgcttaataccccctatagaacggctgaacataatgccgatacggatcattcggataatgcgtatttggctgataaggcttattcatatcatgaatacccgtgttttcagactgtccgcagtatttatcgggacctatcacagttgattgccggatcggtgaaacggctttttcccactcgtgctcattcagacagtacgtatgcgccatgatctcaggcggcgtcagacggagaatatccgagccatatatcacttcaggcgaaggggcgtcaaatatggccaaaaggtgggttttgtctgaagtggcgacttcataatgccaccacccctgcggaacattcgccacttgtcctggagagatcggataattccgtattttctgggtgaacggattcagcatcgacaccaccgcggaacccgaaatacagtacaccaattcagcggcgttttgatgggtatgcggttcaatcacatttgttttactcagaaagatatctaataatgaaatattttcaagcgtgtttaactgtttaatccccaatacattgataaagttccgagcatctttcgtaaaaaaacggctctcatttacatcataagtgaactgtgtattcggagacgtgtaatcgatatcggaaaccatgcaatcccccgctttcatctttaaacgtatattcccaaatatatgtgtccctgtttcaccgggtgataaaaaaggaggtaaaatccataaattccaaattcaacacaatattgtgacgacttttttaaagattcattttagatatatcttttattcgaaatatctcttactataaagatatattaaaaatacatctttagaagggttgaggatgaacatgctggatgagagaacagtagacatcatcaaaagcacagtacccgtattaaaaacacatggagaaaacatcaccggacgcttttataacctgatgtttcaagatcatcccgaactgttaaatatgtttaaccaaacgaaccaaaagaaacagactcagcgcgcagcattggcaaatgcagttattgcggctgcggcgaatattgatcaattagaacaaatcattccggcggtcagacagatcggccataaacacacaagtatcggtgtaaaaccggaacattatccgattgtcggaaagtatctgcttctggcgattaaggatgtgctgcaggatgccgcaactcctgaaattatgcaggcatgggaaaaagcttacggtgttattgcggaggcttttatcggcattgaaaaagacatgtacagtgaagccggatggcaggggtataaagaatttacggttatacagaaaacaaaagaaagcaaagatatcacatcattttatatcaaaccgagtgacggctcttcgcttcctggatttgaagcgggacaatatatcagcattaaagtgaggattgcggattctccttatacgcacattcgccagtacagcctgtctgatgcttctcgaaaaggcgcatatcggatatctgtgaaaaaggacggagcggtttcttctcatctccacaatgaagttcaagagggagataaacttgaagtcagtgcacccgccggggatttcaagctgtcttcttccgaaaaaccggttgttcttatcagtgccggttccggaatcacgccgatgatgagcatgctgaaaacagccgccgaaaaacagcccgagcgttccgttacttttattcatgccgcgaaaaacggagagtacgccgcgttccgcaaagaggctgaacaagctgcggagaatcatccgaatattaacgtcatttatgtatacagtgaaccggcagaacaagaccgctcaggagacaagcctttttacagcggccggattgatcaaaccttcttggagcagcttcatctgaatcaagatgctgaatgttacttgtgcggatcagcacagtttatgacgcaaatgaaagatatgattcttgcactcgggtttgactctgattccgttcaatttgaattgttcggccctcagctgagcatggcataacaaaaaaagactcctcattgaggagtcttttttatttgcacgatgtgttctttctccgtctttttccctattttattgaaattttcatcaatgaccagtaaaattataaatctagtgattccggaattaaaggaaggttgatatgaaaaagaaagcaaagaccaaaagggtgcttgggtgcctttttgctgtatctcttatattcggattatttctggtatcaatggtattttcgaaattcatagtgacggaagaaaaaccgcctgaagaggtggacgagcagcaggtctttattgacagcctttccgggcatgctcaaattttatatgagaaatatcatgtccttccgagcatcaccctcgcacaggccattctcgaatcggactgggggaacagtgagcttgcggggaaagcgcgcaacctgttcggtgtaaaaggtgattataaaggaaaacacgtcacgatgaaaacggatgaatttgaaaaaggaaaacgaaaaacgattcgggcaaaattccgtaaatacagcacgttttttgaatcaatggatgaccatgccaaattatttgtcaacggaacgtcttggaataaaaagaagtacaagcccgtcattgaagcggacaattataaaacagcggcggctgcccttcaaaaatccggctacgccacagaccccggctatgctgaaaaaattaaagatgtcatagaaacctataacctgaatgaatatgacaaaatcaatgcctctcttaaagcagttgataagaaaggcgccatcaaagaccacgccattgaagacgtgtggtccaagccgtcgaaagagcggcattctattaaactggcatcggcgcaaaagtttaccggccagcatattaaagtcgtatctgaaaaacaaaacggagaatccgtctggtaccaaattcaagtgaaagataagctggtcggctgggttgaccaaaccgccgtccagttaagtgaagaaacataagcatcaaaaaaagccggcagcttgccggctttttttacattccttcagtttcaaaccttttaatatcacgtttatgccccatcagcacaaggcagtcacattcatgaatgacagtctccggagaaggggacagctgaatgtctccattatgtttcacggcgagaatggtgcagccgaatctggcgcgtgcgccgagatcaagaagggattttaaatgcagctttttagtggctgaaagctccacaatgctgtattcatctgacaaatcgatgtaatttaagacgttttcatctgaaaggctttgcgcaatccgcacgcccatatccttttcaggatggataatacgatcagcaccgatcttttcaagcactttgtgatgataatagttttgcgctttcacccaaatattagggatgttcagctccttcaataacagcgtcgtcagcgtgcttgcctgtatattggctccgattgctacgatgacatattcaaaatttctgatgccgagcgactgaagctcgctttcttccgttgaatttgcccgcacggcatgcgtggcataagaggagtatgcgttgacccgctcttcgctgatatcgatcgcaagcacctcatgccccattttaaaaagctctttacagatgcttccgccgaaacggccgagtccgatgacggcaaattgtttatttttgatttttcccaatcctcataactccttaagaaactgttttcgtcactccaaatacaacaaacaagaatgtactcctgtttcaggggtttgtcaatgcgagggccggaagaaagaaaacagcacaaaaaaagaccggctgacaagcgatgagcttgtgccggtccgtttttcgcaattatttgcagttgcatggctgtgtcggcggtgtgctgcgtttttgaacaacaattgtgtcctcagcatagaatttagagccgatgcttaatgatttattttctgcacggaacttatatgtacctgcagcaggcaatgttttattattaagagaaagcttaaattccgctgcgccgagcaaatcaatgtttaacggaagtctgactgttttgccgttattcagaatctgtctttcgcgcaaagcgtgtccgttgactgtatcttttgttgtagccgcaaatccgctaggaagggtaaattccataacgcctaagctcaggatcgtgttcggacggtacgtcaattcgatatcagaaaatgaccattcctgctggctggcacctgtatattttgcaaataaggtagcagtcgctttcgtggacatttccggctcgtgaacggttgagcctgactcagcggcgaatgacgctgtcggcagagaaagaagcaaaaccaggccgaataaacttgccatgacagttgagaaaaacttgtgtttcatttttataaatccccctaaaaaaaatttgctgattgttcttaaaaaagaacgaccatacctataaaaatttaccatcaattttaatggaagtaaatggggttatgttcctatattttctcaaaaataatcaaatcacgacaaaaaacgcctgaatcaaaatcaggcgtttttttcgtccgtttctatcggaataaatttaaaaatctccccgctctgaaccgagtcggcgagccgcttcagccaatgataataagctttcgagctttcaagctgatcatataactgccgcgcttcttcctgtaattccgcgctgccttcctcggccagcaaaacggactgcaaatccgcctgagcctgtacgatggcggacaaattcacctgaacttcacggtcccatttcggcggaaagaaattcgtgaaaaacgtaaagaaatccttttccgctacaaacgtatgcttccgtgtgccgcggtgaaaggtttttttgaccacatttaaatcctgcagctttttaacgcccgtgctcatactcggtttgctcatctgcagttcctcacgcatttcgtcaagcgtcatttcatccctcatatacattgttccgtataaaatcccgacactccgggtgattccgtaaagatccatcgtctctgcaatggaatcaatgacaagatccctggcttgttctatagctgcgaattctggattctcatccatactgtccctcttttcctcttgaagtttaaatttgttaagtcatttctttatgttcttaatcttaacgaatcatgacaaaatgtcaaaatctaaacggactgaccgggttttgacaggcaaaaaaacatgtgttaaattaacattgttaaaaacattaaatttttatttaacaaacttacttctcggtaaggaggactcttatgagcaaaacgctttatatcggcggcgaatggatcagtgcagaaaaaaaacagacccgccgtatcattaatccatttaatcaagaagaaattgcaacggtatgcgaaggagaccgggatgatgcggtgaaagccatcgccgcagccagaaaagcatttgatgaaggggaatggccggtgctttccgggctcgagcgcggacaatttgttctgaaaattgcggaattaatcagacgcgatctgaacgaattagctgagctggaatcgcttgatacaggaaaaacgattgaagaaagtaaagccgatatggatgatatcgcaaatgtatttcaatattatgccggtttggcggataaagacggaggcgaagtcatttcatctccgattcccgattcagtaagtaaaatcgtcagagagccaattggcgtatgcggacaaattacgccgtggaactatccgctccttcaggcgagctggaaaatcgctcccgctcttgcggctggaaacacgatcgttttaaagccgagcgagattactccgcttacaaccattaaagtctttcaattaatagaagaagccggtattccgaaaggggccgccaatctcgtgctggggccgggcgcctctgtcggcgatgagctggcgagaaacctcgacgtcgatttggtctcttttacgggcggaattgaaacaggcaaaaaaatcatgcaggcggcaagcggcaacgtgaaaaagattgccctggagcttggcggcaaaaatccgaatatcgtatttcaagatgcagatctcgaaacagctgcagatcaagcgctgaacgccgtgtttttccatgccggtcaagtttgttcggccgggtcacgtcttttggtggacgaagccattcatgatgaatttttagccgagctgatcaagcgcacgaaacgcatcaaattaggaaacggttttcatgaagatacggaaagcggtccgctgatttccgccgagcatcgggccaaagtcgaaaaatacgtagaaatcggtatcgaagaaggggcaaaactggaaacaggcggcaaacgtcctgatgatcccgcccttcaaaacggtttcttctatgaacctactattttctcaaactgcaagtctgatatgcgaatagtccaagaggaaatcttcggccccgttttaacagtcgagtcattctcttcagaagaagaagtgatcagacttgccaacgataccatttacgggctggccggagcggtatggtcaaaggatattgaaaaatgcgaacgcgtagccgccaaactgcggatgggaacggtatggatcaatgatttccacccgtatttcgcgcaagcgccatggggcgggtacaaacaatcgggcttcggccgtgaactcggcaaaatcggcctggaagaatacacggaaatcaaacatatttaccgcaatacgaaacctgcggctgtgaactggtttcaagcataattaggaggagatacaatatgacattaaatatgaaagtagaaagcatgcataaattccatacattcgaaatcccgacagtcattaaacacggaatcggcgcgattcagcacgcgggaagtgaagtcagagcgcttggcgtcacaaaagcgctgctcgtaacagacccgggaatttataacgcgggagtggcaaacccggtcattgaatctttgcaggaagcgggcatcgaagtcgtcctgtttaacaaagtggagccgaacccgcctgtacgtcttgtaaacgaaggatcagaactgtataaaaaagaaaactgcaacggtcttgtggctgtcggcggcggaagctccatggatacggcgaaagcgatcggggtagaagcgacacacgaaggaagcgtgcttgattatgaagccgcggaaggcaaaaagccgctggaaaaccgcattcctccgctgacaacgatcccgacgactgcgggaacaggttcagaggtcacacaatgggcggtcattacagatgaggaaagagaatttaaattcaatacgggcggaccgcttatcgctgcgcatttaacggtcattgaccctgagctgcacacgtccatgcctccgcatgtgacggccatgacaggtattgacgcacttgcgcacgccatcgagtgctatacgatgaaattcgcgcagccgatcactgatgccgtcgctttaatggccattgaatatgcggcgcattatattaagcgcgcgtttgcggacggagaggatttggaagcaagatacggcatggcgcaggcggcgatgcttgccggcctttcatacggcagtgaatcagcaggcgcggcgcatgcgatgagccagacgctcggcggcatcatccctgtcgctcacggacaatgcgtcgcagctatgatgggaccggtaatggaatacaactggaaaggctatccggaaaaattcgcccgcatcgccaaagcattcggaatcgatacaagcaacatgacaaccgaagaagcggccaaagcgtccgtcaactggatgtatgatcttgtaaaagatttagaagtgccgagtttagaagaacaaggtgtgtctccggacatgattgaacgtttatcaaaagaagccatgaaagatccgcagactttcggaaatccaagagatttgaatgagaaagcatacaactggatttacaaacgctgctttgacttaacgccgaaaacggtataataaatgaaccccgctcctttacagagcggggttttttaaggataatgtcaagaaaaaggcggtggtggctgatgtggaaacgcataacagcaaagacggaaggcgtatatatagcggataccgaacaatttgttaccaaaaagatggacaagcttcgcgcggaatacggcgggtttcccggtgacctgcatttcggactgacaaaaaaggccggcgcgcgtgagccgatgtatgaaagaggaacagaaatttttaaccggagacaaatttcaatcgtgtccatggaggaatgtgatgacattgcggagaagatggggatttctcatatctttcccgaatggctcggcgctaacatcgcaatcagcggtttttctgcgctgacgccgcttaaagaaggaagcagaatgatttttccaagcggtgcgtctctgttgtgcgagggagaaaatgatccgtgcattcagccgggagaagtcattcaatccttttatccggctcagccaaaactcgccgcggcgtttgtgaggcacgcgatgggcagaagaggaattgtctgtattgttgaacgcccgggtgatatatgcacgggcgatgcggtcaccatccattcctatgaaccgaaacgcgccaagaaaaaaatcgagaaggtctgactcagaccttctcgattttttgtttgatttcttctatttgatcgatgtgacgcttttcatgatggccgataaaatcaatccactgccggatcgtcagttcttgaaaaacgggatgcggaagcacacgttcaaaatcttcctcgtttaatgatgaaataactgcggtcagctgctgtcttgccgtatctaattcttgttttgcttcaatgactgagattcggttttgctcaggttcgaggtgtgacggcgccggccgtttatttgatctgtcctctataaactccatcggtttgtcttcgatttttttaaacggtgcgtcttttgcctgctttgataaaagggtctgcgctgtttcgtcaattttctttaaatggtcaaggacttcccgcacgctccactcatcagccgcgggctttcggttgaattcctcatcagagagccctttcagtacttcccaggtctgctgtctggcttcattaaaaatgctcatcctatctcctcctttagagtaaacatatcatatccggattggataatcatgtaatcagccttccttatcagaaaattgaaaccatttacctttacatccgtatataaagtaacactccgacacctcagccgaaaggaggatagaatgtggacatatttcatctgccgtttgaaacggtctatctttacacattgattatttcgggaagtctcacgcttttgattctgttttttcaagatgtgtttcacggcctctcagaagccattcctgtttcatttttaaaccctgcattgattctgtcttttttaacaatcttttcagcctcaggttatatcggcgaaatcgccgctccgctatcaagtcctgtcattgcgttgctttcatttgttctttcggttcttttggtcagcctgcttcacttcttcgtccttgccccgctttcatcagcggaagaatcgctcgcatatcgggagacagatttaaagggcagggtcggcagggtcattacttccgtcccgaaagacggctatggggaagtgatcatagagggaatagggggcgccatttctaaatcagccgtcagctttgatcaagaacagatcagatacggaacggccgtattagtgattgacgtgaaagacggagtgctttttgtgacgccgcatgaaccaatctgatatctaagggggaactgttatgactatgccgattatcattgttatcggaatcgtattctttttactcatcgcacttattgctgtatttattacgaagtaccggacagcggggccggacgaagcccttatcgtgaccggaagttatttgggaaataagaacgtccacattgatgaaggcggaaatcgtctgaaaatcgtccggggcgggggaacgttcgtgctcccggtattccagcaggcagaacctctcagtttactgtcaagcaaacttgatgtctctacacctgaagtctatacagagcaaggggtgccggtaatggccgacggaaccgccattattaaaatcggaggctccatcggtgaaatcgccacagcagctgaacaatttttggggaaatccaaggacgaccgtgagcaggaggcgcgggaggtgctggaaggccatctgcgctccatcctcggctccatgaccgttgaagagatttataaaaacagggaaaagttttctcaggaagtccagcgggtcgcgtctcaggatcttgctaaaatggggctgatgatcgtttcttttacgattaaagacgtccgggataaaaacggctatcttgaatcattaggcaagccgagaatcgcccaagtcaagcgggatgcggacattgccacggcagaagcggataaagagacgaggattaaacgcgcggccgctgataaagacgcaaaaaaatcagagctggagcgggcgacggaaatagctgaagcggaaaaaatcaatcagctgaaaatggcggaatacagaagagagcaggatacagcaaaagccaatgccgaccaggcatatgatcttgaaaccgcaaaagcgcgccagcaggtgacagagcaggaaatgcaaattaaaattattgagcggcaaaagcagattgaattggaggaaaaagaaattctgcgccgtgagcgccaatatgactctgaagtgaagaaaaaagccgatgctgaccgttactcggtggaacaagcggccgcggccgcaaaagcgaagcagctcgccgaagccgatgccgagcagtacagcatcgaagcgatggccaaggcggaagcggaacgcgtgagaattgacggtcttgctaaagcggaggctgaaaaggcgagaggagaaaccgaagcggaagtcatccgcctgaaaggtctcgcagaagcggaagctaaagaaaaaatcgccgacgcattcgaaaaatacgggcaggctgcaatccttgatatgattgtgaaaatgctgcctgaatacgcaaaacaagtctcagcgcctctttcaaacattgataaaattaccgtcgtggatacgggaggaagcggtgaaaacggcggggccaataaagtcacaggctacgcaaccaatttaatggccggtctccaggaaagcttaaaagcatcttccggaatcaatgtaaaagagctgattgagaatttttcaggcaaaggaaacataaaacaaagcataaatgaacttacaaaagaactgagtgattctaacgaacggcacagcccggaataaaaaaacagcaggcgtaaaccgcctgctgtttcagttcgtccgcttagcttcaagaagccgcggcgcagtcatgaataataagataaggacaatggccgaaaggataaaagaaggaatcatgtaagtcgcgttatagacggatgaataaatccagaccggcgtacccttcggagcatagcttccgaaaaagactgctccggagaccacatgcgccgcataccgcagcacactgccggtgaaaacaccgcctataacatacatcgttaaagcgcctctttttttattcaatgccgatgctcgtacaccggaagcgagcaagccgctgaaaccgagaactgcaaatgccgcgatataatcaagaaatagctgcaccgggtgctgcaaaaacaaattgccgatggcgatctggacaatccctgttaaaaagcctgtcgtaagcccggccttcactccccagcggaatgaaatcaaaaaaatcggaatcatcataatagagaccgaacccccttggggcatccggagaaacatgcctgagacaatgtccagaatgacagccgccccggtcataatcgctatttcaattaagcgcacaagctgtgttgaatgattcatagttttccccctggtcagacaaccgtatcaaggataaacaaaaaagcagcgcggggaaggatgggaaaaggtccgcgcgctgcttacataaactgcaaatcatttggctttgccacatccctacgccagcgttaactaacaggttcaaagggtcagaacaaaacgttcactctcagctttaatgctccccttgtggtcatcaagtatttagttcaatcttactatacaagaaaatataccaaaccacaagacagcttatctttctatagaagagaaactgaaataagtatgaaagaaaataattaatgattttttttaaaaaactattgtcatattttcaaaagggtgttatattattaaacgtcgctgatgaacagcagacaacaacgaaaagcttcggaaacaacttaaaaaaagttattgacataaaagaagctgggtggtaagataataaagctgcttcaataagcggtcatgatctttgaaaactaaacaagacaaaacgtacctgttaattcaaagttttaaataaatcgcacagtgatgtgcgtagtcagtcaaactaaggtctgcacgatgcagatcacacagacgttactgcaggatgcagtgaacttagtctgtgttccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattccttcaaaacataggaacacctgctaaatgcgccacttcctgtggcaacgcatgtgttagcatgtcctatgcgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagccattacacgtaagtgtaatatacggaggattagctcagctgggagagcatctgccttacaagcagagggtcggcggttcgagcccgtcatcctccaccattccaatcatacataagttggcgtattaggccggtgtagctcaattggtagagcaactgacttgtaatcagtaggttgggggttcaagtcctcttgccggcaccacttttatatgttatactatataagtctcttgtaataagagccattagctcagttggtagagcatctgacttttaatcagagggtcgaaggttcgagtccttcatggctcaccatgtttttcttgcggatgtggcggaattggcagacgcgctagaatcaggctctagtgtctttacagacgtgggggttcaagtcccttcatccgcattgccaaacgcggaagtagttcagtggtagaacatcaccttgccaaggtgggggtcgcgggttcgaatcccgtcttccgctccaactatactataccatccatgccggggtggtggaattggcagacacacaggacttaaaatcctgcggtaggtgactaccgtgccggttcaagtccggccctcggcacttattgttgcgcccgtagctcaattggatagagcgtttgactacggatcaaaaggttaggggttcgactcctctcgggcgcgccatacatacttttgaaaaacgggaagtagctcagcttggtagagcacatggtttgggaccatggggtcgcaggttcgaatcctgtcttcccgaccactttggggccttagctcagctgggagagcgcctgctttgcacgcaggaggtcagcggttcgatcccgctaggctccacttgattttaattgtttttggcggtgtagctcagctggctagagcgtacggttcatacccgtgaggtcgggggttcgatcccctccgccgctaccattggacctttagctcagttggttagagcagacggctcataaccgtccggtcgtaggttcgagtcctacaaggtccaccacttatacggaggaatacccaagtctggctgaagggatcggtcttgaaaaccgacaggggtgtcaaagcccgcgggggttcgaatccctcttcctccgccatatctaatttaattatcatcgcggggtggagcagttcggtagctcgtcgggctcataacccgaaggtcgcaggttcaaatcctgcccccgcaaccaaaaaatggtccggtagttcagttggttagaatgcctgcctgtcacgcaggaggtcgcgggttcgagtcccgtccggaccgccatttataaaaaggctcggtagctcagttggtagagcaacggactgaaaatccgtgtgtcggcggttcgattccgtcccgagccaccatttaatttaatattgttttggcggttgtggcgaagtggttaacgcaccagattgtggctctggcactcgtgggttcgattcccatcaatcgccccaaacaacatgcgggtgtagtttagtggtaaaacctcagccttccaagctgatgtcgtgggttcgattcccatcacccgctccatttttatattgtcatgggcctgtagctcagctggttagagcgcacgcctgataagcgtgaggtcggtggttcgagtccactcaggcccaccatgatgatttttccacagtagctcagtggtagagctatcggctgttaaccgatcggtcgcaggttcgaatcctgcctgtggagccatacggagaagtactcaagtggctgaagaggcgcccctgctaagggtgtaggtcgtgtaagcggcgcgagggttcaaatccctccttctccgccataaggcccgttggtcaagcggttaagacaccgccctttcacggcggtaacacgggttcgaatcccgtacgggtcattaaaaaaaccttgcatagtatgcaaggttttttattatgcgttcatagcgtaaatggtaaaagacaggtatgtggcaaaagcgctccataataaataaggaaccagaagccaggctgaagctttactgtatttaccggcaatgagcaacagaatgagtgttgtcacagccacaagcaggcaatcgatagatgcagcaagcaaatttttctgtgtgaattgaaaatagctgaatccttgattcacgatataattgatgagaagcatcacccaaaaagctttggattctttacatgaaaactttgcatatattaaggctgctgagagcgaaataagcgcaaacaaaaccgcccatatgatgccgatcactgatccgcccagcgtccagtcaggtttttgcagcgcgtcgtaccattcccggtcgatgggaaagagaaaccctgctaaagaaaacaagacatatgtaatgataaatacaataatcgcaccgatatacttctttttcatttgttccctccgtcattcaatgtcaatacgttagttccctttcttggaaagattaaaccgttcaaaaggttcatgcaccattaagtgtatgagttttcggtgtgaaaatgcagcaaaccaattatttgtattcaaaaaccccggcctgccggggttttaatcagcatgaaggtcgccaaaggtcgtcataattccttcttcgtccagttcctgctcatatttttcgtgtgccttgcttggatacacggaaatgttttttccggtaatatctgtcgcgataaagttttcataatcctcagcatagccgatgttttcttctgagttcattgtcatatccccatagctgagcggcggatcttctaaatcctgaggcgtttctgagtttccgtatccctcaacatcctgataagcatcttcactatcgtaagccgcccggattgattcatcatcatcaaattcaaactgtccgaacggtgtttcctcttcaatcggcctgtctttggaaacggcatcctgcgaggaatattccgccaatgtcgtagccgtcggcagagcttcaagtctgtcataaggaatgtccttgccgctgacttcacatgtgccgtatgtgccgttttcaatttgtttcagagagtaatcaatatcgcgaaggtgctccctttcatggtcgagcagagccaggtctttttcccgctcgtataattcggtcgcctgatcgccgggatgattgtcataggaagacaattcgccggatgattgatacgggaattcatcagttaactgaaattgatcattttctttaaagcggcttaaaatatcatctctggcttcttccaattctttttttaagtgtgtgatctgttcgtttgtaagcacatcaatccctcgtttctatgtgatgcttactgttagtatgaacgtttttacgcagaaaaatggtggataaaaatagtcattttcccacgaggaagtaaaaggatacagtgattgccgagagtggggaaagaaaattcaagtttgtttctttattcatttgcgcaaaaaggtttataataagaaatgcaggcattttgtcgtgctcaaatctgtgtgtttgacacaaattcatcacaggtgtattgtattaaaagcatttaacggattatggaggaatgtctcatggtgacaacggtgcagcatacgttccgagaggaagcagatcatgcattacataaagccaaacaagtcaaccatgctgtcttattgagctattcaagacgtattgcgtctttagaccctctatcatttttcaaagacggagcaaaaaaatataaaggcaaacgatttttttggtcagaacccggtagtgaattaacaatagtcggtcttggcacagaagcgctgttccaatcgaatgaaaaaaatggaaaacgttatcacgacgtttttgaacaatgggagcgctttaaaaagacggcttttcatattcatgaagaagaagaggcggcgcataccgcggtcggccctgtcttattcggcggtttttcatttaatcccgctgaagagagaggagacgaatggaacgggtttgaagaaggaatgttctttatcccctcactcatgctgacaaagacggcagacggcgattatttaaccgtcaatcaatgggcggcagacggtaatcaggcagaagatacgctgaaacgtctgaaatctttttcagaagcttttgcagtttcttcaattgagtatgaagaatatcctgttttaacaaaagcggaagaacttgatgtggaaaactggcttgaagccattaaaacagcaacaaatgatatgaaggcaaatcaatatgataaagtcgtgctggcaagggaagtcgttttgtcatatgatgggcctattccggcggagagcgttgtccgcaagcttttgacggaccaaacgacaagctatgtttttgcgattgagcagggagataaatgctttgtcggcgcttcaccggaacggctgatcaaaaaatcaggcaaagacgttatgtccacctgtctggcaggttcaattaagcgcggagaaaatcaacaagaagatgaccgtctcggcaaagagctgctgcatgacgaaaaaaatctcgcggaacatgattttgtggttaagatgatacacgattctttcttgtcgagctgcagtgatgtgaaaaagcctgcaggcccgcaattatataaaacaaaaagtgttcagcatctatatacgccgatcacaggcaatctgaaaacgtccgcttcgctgtttgatttaattgaaaagctgcatcccactccggcattgggaggagctcctcagcagaaagctgttgaagttatcgctgatattgaaccgatgacacgcggatggtatgcggctccgatcggctggatggacggcagggaaaacggagaatttgtcgtggctatccgatcagggctgattgaaggcaaaagtgcgcggcttttcgcaggctgcggcattgttgaagattcagatccgcaatcagaatatgaagaaacacaaattaaactaaagccgatgatctctgctttaggaggtgaaaggctttgacaaacccgattacacattatatcggaagctttattgatgaattcgcgctatcgggtgtcaccgacgcggttgtttgcccgggatcgaggtcaactcccctggcggttttggcggcggcccacccggatattcaagtccatatacagattgatgaacgatccgcaggttttttcgcactcggtcttgcaaaagcccgccagcgtccggtcatgctgatttgtacgtcaggaacggcagcggctaacttctatccggccgtgattgaagctcattattcaagagtgcctcttattgtcctgactgctgaccggcctcatgaattgagggaagtgggggcgcctcaggcgattaaccagcattttctgttcggtaactttgttaagtttttcacagactcagctcttcctgaggaaaaacctcaaatgcttagctatatcagaacattggccggcagatccgtaagtgaagccgggaagcgcccgatggggccagtccatatcaatgtgccgctcagagagcctttgatgccggatttatcagccggaccttttgaaagaatgagaaaggggaagcacgtctcagtcacaacagggattcagtcagctgatcaagactctctctgtcatattacagagcgtctcgcgggtaccgaaagaggtatgatcgtctgcggcgaaattcacggtgaagcagaaaagcagcaaatcatcgcgcttgccgagatgcttcagttcccgattttggctgatccgctttcaaacctccgaaacggggagcatgataagacgctgattattgatgcttatgactcgttcttaaaagatgaagaaataaaagaggcgctgcgccctgacgctgtgatccgcttcggtccgatgccggtttccaaaccgctctttttatggctcagagacgatcctgccattgagcagtttatcgtcgatgaagacggaggatggagagatcccacccaggccggcgcgcatatgattcattgccatccgtctgtgtttttggaagcggtccgttcagctgaaaccggaaaacggccgtccggatggcttgagaaatggcaatttgtcaatgaccggttccggagtcatttacaggccgcgagcatggatgatttatcatttgaaggaaatgtatatcgtcagcttcagcaccttgtccctgaaggcagttcgatttttgtcggcaacagcatgccgatccgcgacgtggatactttctttgaaaaacaagatcgttccttccgtgtctatgccaaccgcggcgctaacggcattgacggagttgtctcctcggctatgggactgtgtgaaggtacaaaagctcctgtcacgcttgtcattggagatttatcgttttatcatgatttaaacgggctgttagcggctaaaaaacttggaattccgcttacggttattttaataaacaatgatggcggcgggattttctcgtttttgccgcaggcatctgataagactcattttgaagaactgttcggtacgccgacgggtcttgatttccggcatgccgccgcactgtatggcgggacgtatacttgtcctgagacatgggaagcatttaaggatgcgtatcagccgcaggcggacaagcccggacttcatataatcgagctgaaaacagatcggacatcaagagttcaattccatcgcgatctgctgcaggccgcagtgcgggaagtgaaaaaagaatggaaactgtaacagttaaaacggccgacggcgtatgctatcgtgctgctgatagcggacacggacacgaatcgtctgaagctattgtttgtctgcatggatttacgggcagcaaagaatcatggatgtttttacgcggcatgtttcccggcgagcgaatggtgatgattgactgcctgggtcacggggagacagacgcgcctgtgcaagcggcaaggtatagtgcgagccggcaggttgcggaccttgccgccgtttttgatcaattaaaacttcacaaagtgaaacttattggttattctatggggggaagacttgcgtattcctttgcacaggcatttccgcatcgggtgtcagcgcttgttttggaaagtacaaccccgggcctcagcacgcttcaggaacgcaaaaaacggattcagtcagaccggaagcttgctgactttatattgcgggaaggtgtaacatcgtttgttgattattgggagagcattccgttgtttgccacgcagctttctcttccggacagcgtaaaggcgtccatccgtgccggcaggctgaagaataatccgtccggacttgcaggaagcctgctcggaatggggacaggctcacagccttcctggtgggaggcattacaccgcatcaaggcgcccgtcctgctcatatgcggtgaatgggatgaaaagttttgcgctattaatcaaaaggtgcataacctgctcccatcaagtaaaatagaggttgtcaaacaggcggggcacacggtacatgtggaacagccgcgaatttttggtaagatagtaagtgagtttttatacggcttgtaaagcataaagaaaatagcttttcggccggactcaggcaaaaatgaaggaggtcatatcaatggctgcagaatggaaaagtgaacgtcagtacgatgaaatcctgtacgagacgtataacggtattgcaaaaataacaattaaccgcccggaggtacataacgcatttactcctaagacggtatcagaaatgattgacgcgtttgcttgtgcgcgtgatgactccaatattggtgtcatcgttcttgcgggagcgggagataaagcattctgttcaggcggagaccaaaaagtccgcggtcacggcggatatgtcggagacgatcaaatcccgcgtctgaatgtgcttgatcttcagcgtttgatccgtgtgattcctaaaccggtcgtagcgatggtatcaggctatgccatcggcggaggccatgtgcttcatatcgtctgtgatttaacgattgcggccgataacgcgattttcggtcaaaccggcccgaaagtgggtagctttgatgccggttacggctcaggttacctggcgcgtatcgtcggacataagaaagcccgtgaaatctggtacctgtgccgtcaatacaacgcgcaggaagcgctcgacatggggcttgtcaatacggttgtcccattagagaaacttgaagaggaaacaattaaatggtgtgaagaaatgcttgagaaaagccctacagcccttcgtttccttaaagcggcatttaacgctgatacagacggcctcgccggaattcagcaatttgcaggagatgcaacgcttctttattacacgactgacgaagcgaaagaaggccgtgattcctttaaagagaaacgcagtcccgatttcggtcaattccctcgttttccgtgatcagatgacactacgaaacagcttgagccgctctggtccaagctgttttcttttcaaaaacagtacttttacctcggagatgataacatgctgacagaacagccgaattggctcattcaaagggctcagctgacaccggagagaatcgctctcatatttgaaaacaaacagatgacattcagagaattatatcatgcttctaaacaaatggccgcgcggctgtccaaatactgctcgcttaaaaaaggagacagggccgcgattttgctttctaacagaccggaaatggtttatgccgttcacgcctgcttcttattaggggcggaagctgtgctgttgaatacgaagctctcaaaacaggaacggttgtttcagctcgaagattcacaggcaaagcttttattgacggaggacggtttttgccgcgaagaatatgaatctgcggtcgccaccgcagatgtggacgagctgcaggctgaagaggcgggtgacatggagccggaagcttatgtaacgcttgatgatacggcgactcttatgtatacgtcaggaacaacaggaaggccgaaaggggtgcagcagactttcggtaatcattattccagcgctgtatcgtctgcgctgaatctgggggtcacggagcgggaccgctggcttattgcgctgccgctgtttcatatcagcggtctgtctgcgctgtttaagtcggtcatttacggcatgcccgtcgtgcttcatcaaaaattctctgtcactgatgtgctggacagcatcagctcccatcaggtcacgatcatttcagcggtgcagaccatgctctcgggcctgcttgcggaaactgaacaatgtcctgaatcactgcgctgcattctgcttggcgggggtccggcaccgctgccgctccttgaagaatgccgcaggaaacaatttccggtattccaatcttacggcttgactgaaacctgctcacagattgtcacactttctccggaattcagcatggacaagctcggctcggccggtaaaccgctgttttcatgcgaaattagaattgaaaaagacggaaacccttgtgcgccgtttgaacatggtgaaattacggtgaaaggcccgaatgtaatgaaagggtattatcatcgtgacgacgcgaaccaggccgcttttcataatggatggttcaaaacgggcgatcttggctatttggatgatgaagggtttttatacgtgctggacaggcggtcggacctcatcatttcaggcggagagaacatctaccccgcagaagtggaagcggcgctgcttgcccatccggctgtagcggaggccggtgtttcgggagccgaagatccgaagtgggggaaagtgccgcatgcttttctcgtgctgacttcttctgtcagttctgaggagctgaccgccttttgccgtgagcggcttgcaaaatataaaataccagctgcttttttcaaggttgacgggctcccgcggaacgcgtccaataaactgatgaggcatcggctgaatgagcttcgtaaaggagaattgtcatgattaagattgaaaaaatcaccctttatcatgtaagtatgaggctgaaaaaaccgtttaaaacaagtattgaaacgctgcaggatcgtaaatttttgatcgtggaagcgatcgacgaaaccgggagaaccggctggggggaggtatcggcgttttcttctccgtggtatacagaagaaacgattcagacatgcgcgcatatgctgagagattttttcatcccaaatgtcgtaggccgcgcgtttttccatccgtcagaagtgcctgacagtctcgcgcgtttcaaaggaaaccgcatggcaaaagcggggcttgaatcagccgtgtgggatctatatgccaagaaaaaggggatatctctcgcagaagccttagggggcaaaagagataaagtgcccgccggcgtggcggtgggtctggcttcggctgatgagatgcttcgggaaattgagcaatacgtaaaagaaggttatcaacgtataaaaataaaaattcagcccggccatgacgttgatctggtcagagccatccgcagccgttttccgaacgtgccgctgatggcggatgccaactcggcttatgaactgaaagacatcagcaggctgaaagagttggatgaattccagctcatgatgatagaacagccgcttcaggcagatgatattgtcgatcaccgccacctgcagaaacacttaagaaccgcggtatgccttgatgaaagcatatgctcttatgatgacgcaaggcgggcgattgagcttgggagctgtaaaatcattaacataaaaccggcgcgtgtaggaggcctgacagaggcattaaaaatacatgacttatgcagagagcatcacatgccggtttggtgcggcggaatgtttgaaaccggcatttcgagagcgcagacagtcgcgcttgcttcgctgccgcaatttacgataccgggtgatatttcctcatcagaccgatactgggaggaggatattgtcactcccgatatccgtatcgaagagggattcatctctgtcccggacggtcccggactaggtgttgaagtcaatcaggaaataatgagaaaatacgtcacccaaatggacgtttttacgacaaacaactgataaaaagacatttcagcgagttgagctgcctgtacgctgctgttatattgaagctgttcattatcaccccttcccccgtttgaaccggctgtatcagccggtttttttaataggcggatgcgatgatttttttattcttcaaacagtgccggctttacaacgcaggtgctgctttccggctggggcaaacatgtacatcttgataaaaaattctgagcttgtcatgaatgcgatactgattgtaccgtctgccgcctatatttgccgccgaaccgcctttttgccatgcttctcatccgcgcggttttctccggctcagggaggcttgcggcggaaatgaaaaagagctgtataaaacagctcttttcttttataaatcttgcggtttaaaggttttgcaatccgtttcttcacttttttcagcggtttcgcctgtatggctgaccacataaatagcgtcggccgtgcatttgtttcctctgccccaatatgaacagttattgacttcacacagaattttttggtccatgctggctcccctccaagataaaaggtacgccattagtatgagccgccctgatttttgttattcctcctggcggatataacgtctgtctttcataaagagcttccagaagaaataaaacccggggaacaaaatgatgaaagcgacgatatacgtcataaacagcgccctgaaggttgccggctccgtaaatcctgacatgaccgtaatatccggataaatcatataaggaagatgagcccgtccgtatgcatagcttgccagaaagtattggagcgcaatggcgatcatggcgattctcggtttgccgaggttgcggccgaagcgcttattcggcaaaaacagagccacgccggcaatgataaatgtaatgacagacagaatgagccatgtcttgtctttcatcatccccgtatacagccagccggcttcagagcgtaatgtcagcataatgaagaaggcaaacagaagcgacagcggccctgttattaaagagctccgtctgtagatgcggtacgcatgctcctcttccgcaacatttgaaaaatcggccagaagcagtgaagataaaaataaagtgcttaaaatggcaaagccgataaacgcatacgcattaagacttgtaaagacatttgccaaattcaggtgatacactccgcccgtcttctcaataaaccctccgtgtgtgaccggaaggaccaaaatcagcacagcgggaataatgaagcctgaaattccggagatatatctcatgatttttctttccttcgccgtattggagaagacgagaaagccgctgcggatggctaagagcagcaaaataatacttcccgggatcaataaaacggttcccagcacgaaggttgcccctggaaagaagctgaatagggcgacaacgatcgcgacgataaagacgttggtcacttcccatgtcggggacaaataacggttggcgatgtttgtcgcctttgtttgttctttatttaaatatatcatcgaccaaaagccggctccgaagtccatcgttgccatgaccgcgtagataaacacgaagccccatacgattgatatcgcaatgagagcatccatggtaatgtccatttcaattcagccctttctattgttaggattccgccgcttttacatcctcctcaacaggatgtttgcggaaataataaagcagcacataaatgactgcggctgccaaaatggcgtaaaccactgtgaacaggatgaacagcaaaccgattgaaccggttgtcgtgacgacatcagacgttttcaggagatggtaaatcacccatggctgccgccccgtacaagcgaatatccacccgaattcaattccgatcagactgagcggtcctgcggttaaaaataaaatcaaaagccaagtcggaaagctgtctttctttaaaatttttctccacacgatgccgatgatggagtacaaaatgagcagcatcccgatgccgaccattccgttaaacagtgtatggatgaataaaggcggccactcgtctttcggaaacgcgttcaatcctttgacgacggtatcaaagctgtttgcggccaaaaagcttaaagcccacggcacttctatcgcccattttactttttcttcttttgcatcagtaaaacccccgatcgcaagcggagcgtgtgatctagtttcaaacagcccttctgcgcccgcaagcttctcaggctggtattcgtaaagaagctgggctgactcgtgaccgtttaaagaagcaataatagagaatatcccgccgatcgttaaagcgagcagcagcgcttttcggtgaaagcggtatacctgctcctgttttctcgttctcagcattttataagccgcaactgacgcgacgataaatgcaccggtcatgaaagccgtcagtacgacatggcccgcggtggtgaaaaagcttggattaaaaaacgctgcccacggttcgacgtcagtgattttgccgtttaaaattttaaagccggccggcgttccttcaaatgcgtgaacatttgtgattaagacggcggatgccgcggcgccgatcaaaacgaaaataacggcaatgatgcgcatcgccggagtcagccggtcagcggcgtagacataaatggacataaacagcgcttcgataaagaaagcataaatttcaatctgaaacggaagtgacatcaccctgccgatgatctccatgaatccgggccacaaaagggcaagctgtgtacccgcgatcgttccggtcggtatcgccacgccgagcagaacagcctgcgccttcgtccaccttttcgccataatggcataatgcggatcttttgttttttgataaatcaattcggccattaaaatcatcagaggcaagccgacaccaagcgtcgcaaaaataatatgaaagcccatggttgtcccgaacagacttctggctaatactaaatcatccacgatcataaaccgcctttctaaattaccgttttatgtaatgtggttatattatttgctgaagcgattagattattcttccgattccatatatgtgcagggtttagaaatcaagggatcagggcatatatgattgacaagcgcctatttaaggtttagaataaaacgtaattattacgatttaagaaagggagatcaccatgaaaaaagatattcatccggataaccaccaagtgatttttcaagatgtgaacagcggctaccgctttttaagccattctacgaaaacgtcagaggaaacggcagagtgggaagacggaaaaacatacccgctgattaaagtggaagtcagctcagatacgcatccgttttatacgggccgccaaaaattcaacgaaaaaggcgggagagtcgaacagttcaacaaaaaatacaatatggggaaataagacaagcccaatagggtttgtcttatttattgagcactttatcatctcgtgcggggagtgacgaaatgacccgccttatgttatattgtgaataaaaaagcagaaaggaaacaccaagatgagtcttctaaacgatatcatgcaatttaatgagcagttcactaaaaacaaagattatgaaaaataccaaacatctaaattcccggataaaaagatggcaattttgtcctgtatggacacacgtcttgtagaattgcttccgcatgcgatgaacatgcgaaacggcgatgtgaaaattattaaaagtgccggcgcgcttgtcgcccacccgttcggaagcatcatgcgcagccttttagtggccgtatacgaattaaacgctgatgaagtctgcgttatcggccaccatgattgcggcatgagcaaaatcaacagcgaggatatgcttgataaaattatcgaccgcggtattccgaaagagcggattgacatgctgaagcactcaggtgttgatcttgatcaatggctgaaaagctttgattcagtagaagcgagtgttacagacagcgtaaacgtcattaaacaccatccgctattccctgacaatgtcccggtgcacggtctggtgattgatcctgaaaccggtaaacttgatctggtgatcgacggctaccagcatatggactaatgttttcgttttttgtccggtacgggatcaacaccgcccggatgaaaagggtggcactttaaaatccgcttcagtgtcagccatccgccttttaatgcgccgtgagtcttgacggcttcgattccgtactgtgaacacgtcggataaaagcggcatgacggcggcgtcagcggagagatgaacttctggtatccgcggatgagcgcaatcattatggttttcattaaaaaaccacctttctgatgctagtatagaaaaaaaatttcagattgaaaagctttcgccacaattcttatcggaaaactgtgttataatggatgcatattctgaaaaaaagggagtgccattatgccttcagtagaaagttttgagctagaccataatgcggttgtggctccgtatgtaagacattgcggagtgcataaagtcggaacagacggcgtcgtgaataagtttgacattcgcttctgccagccgaacaaacaggcgatgaagccggatacgattcatacgcttgagcacttgcttgcgtttacgattcgcacacattctgagaaatacgatcacttcgacatcatagatatctcaccgatgggctgccagacaggctattatcttgttgtcagcggcgagcctacagcggaagaaattgtagacctgctagacgctacgctgaaagaagccatcgatattacggagattccggcggccaacgaaaaacagtgcggccaggcgaaacttcatgatttagaaggcgcgaaacggctgatgcgtttctggctgtcacaagataaagaagatttgctgaaagtgttcggataaaaaacaggcctttttgctgacatgcaaaaaggcttttttacatatttctaaaaaatgtcacaccttatgtgtaagcgtttgctaaaatagaagcaaacatgaaggagtgatgggatgaaacgggctgtattggcaggtatgtgcggtatggtatttctattatcttcctgcgggggcaattcggacaaaaccgccgcggatgaggagcctaaagcgcttgaggtcaagcttacaggaccggaaacggcagcaccgcatgaaaaaacggaatacaaggcggaggttttttacggcggcaagcgtgtcacggatgcggatgaagtcatgtttgaagtatggaaagaaggaaaaaaaggcagcagcaaaacaagcaaggccaaggaggaaaaaggggcgtatcacctgcggactgaatttgatgaagagggtgtgtataccgttcaatcccacgtaacggcaaaacagcagcataatatgccgactgtaaaagtacgtgtcggggatgctgaagctgccgatgattcctccggccatgaggaacagacgcatcatcattaaggattgtttttatccgtcaagccttttgatgcgtcctccggcgggtcaatcgtatgttttacgttataagctcttacagtcgaccagatggataaaagcagcacggcgagcacgataagaaagccgaagctcagaagaagcagcatgaaatccctcctttttaacaaatcataacatattttccatccgtaaaatcaagggctaaaaatttatgttttaacacacgatatatagggtatatcaatagtaaatcaaaggaggaagataggcatgtcagaaaaactattggaagcggtcaataaacaagttgcaaactggacggtcatgtatgtgaaattacataactatcattggtacgtcaaagggaaggactttttcacattgcacgaaaagttcgaggagctgtataacgaaacggctacatatattgatgatctggcagaacgtctgctggcattgaacggcaagccgatcggcacaatgacggaatcattgaagagtgcttctataaaagaggcggaaggcaatgagagcgcagaacaaatggtacagaacatttatgatgatttcactgtcattgcggaagagctgaaaagcggcatggatctcgcagatgaggtcggagacgaaacgaccggagatatgctgcttgccattcaccagaatatcgaaaaacataattggatgctgaaagcgtatttaggataatcaacaagggaagaccggggctataaagcactcggtcttttatttggctgccgaagagaggtgttgtccatttttctgaaaaatccagtccgttccattcacttttcatagaataatgtaaggccgtttctgtgaaaggatgttggatcaagtgggcaaagactttggcatcttttcgttttttgcagtgatcgtgtcggcagcggggtttttctttggcggttttcagtattcgtttctgattttgctatcggtcatggcgattgagtttatcagtacaagcttaaaagaatctcttttgcagcagctgagcgcaagaaagctttttgcgcggctggtcaaaaaaatcgtgaccctggcattagtctcagtttgccatttttttgatcagctgcttcattcagaaggcgccatccgcaatttggctattatgttttatatcttatacgaatcggttcagatcgtgattacggcaagctcgctgggcatcccggttccgcaggtgctcgtcgacctattggatactttgaaaaataaattcaagcgcaaaccgtaacatttgcttcaaaggaggctatactagcgggtatgatggttttcctctgaatttttgataaagggcttccgaacaaacgcaactgtggtatgatgtatggaagatatgaaggaacggattagagggataaacatgtacgagtttaaagactattatcagaatactgttcagctctcctttgaacaccagcctttttcagacagcccgaagcatgtatgggtcatatgccgatatggagataagtggcttttgactgagcacgaagaccgggggtttgaatttccgggcggaaaagtggagccgatggaatgtgcggaggaagcggccctgcgcgaggtgaaagaagaaaccggcgccgcggtaagacatctgaagtacgtcggacagtataaagttctcggcagggaaaaggtaatcgtgaagaatatttattttgccgatattgaaaagcttgaaaaacaggctgactattttgaaacaaaggggccggtgctgttcagcgaactgccggagaatctcccccgaaataaaaaattcagtttcattatgaaagattcggtgcttccgatcagtctgaaaaagctgaaagaggacggcgtatttcaatcataaaaaacggagacccggcgcttacgcacgggtcttttttatatttttcctttcgtccattttctttctaacagttcgactccctgatacatcaatgtcgcaaaaatcgcgatgatcagaaggcttaagaacacaagagtgaaattgaagacctggaatccgtaaatgatcatgtagcccagacctttttcggaaacgagaaactcgccgacgatgacaccgacccaggataaaccgacgttcactttaagcgcggaaataatcgcgggggcgcatgccggcagaatgacttctttaaacatgatgcttcttttcgctccgaaggttttcatcaccttaatatagttttcatccacttcctgaaaagccgtaaagacgacgattgtcgtgataatgacactgatgactgctcccatggcgacaatgcttgtgaaattcggtccgagtgccacgatgagaatcggtccgagtgcgaccttcggcatcgcgtttaaaatgacgaggtacgggtctaaaacccgggcgagtctgtttgaccaccataacagagcggcgaggcatgtgccgagaagcgtgccgagcaaaaagccgagaacggtttctcctaaggttacgccgatgtgcgccgcaagggatccgtccgcaatcttttcaactaaaagcctgcaaacggcggagggtgagctgaagattaacggatcgatccagcccgccctgctcgatatttcccacccggcaaaaaatacgatgaaaatggcggcctgatacgcacggatccggagcttttctttttggtgtcttttcttaaactgctgatgaagctgttcaatcgtgccgctgctgtttttcaagggaattcagctccttccatatggtttgaaacagcggctgaaaggccggatcctgacgcgcgtcaaacggatctaaagccgcgagctccttaggcacggtgaatatttggtggatggtgcccggctgattcgaaaataaatagatcgtatcgctcatggcgatggcttcaccgatatcgtgggtgacgagcacggcggttttttgaaaatcctttaatgttctgaagacaaggttttccaaagaaagcttcgtttgaaagtccagcgcggaaaacggttcatcaaggagcagcagtccagggtccggcgcaagagttctggcaagtgccgcccgctgccgcattccgcctgagagctctttcggatatttcttttcaacgccgattaatccgagcttaggcagaaggctgagaacttcagctcttttttcttctgttaatgtttttgaaatgtgtaaaccgagcagcacgttttcctcaatcgatttccaaggaaataaataatcctgctgaagcatataaccgatttggtgttctttatggttcggcacgcttccttcgatcagcacccggccttgcgcaggggtgataaggccggccagaatggacaggagtgttgtttttccgcatccgctcggcccgagaaaggagatgaaatcccctttttcaatctgaaaatgtatatctttcacggcggttgtcttttctttaagcgagaaataagtatgtgttacatgatccacatgtaaaaaagacattcatgttcctcctattgttctgaggtgacttttttggcgatttttgtgttgacgagtttgctgtacggaatgtgtttcgggagctctccggcttcatccataatagattgaagcagttcccattcatccttttgcagaactgggtctgcagagaatgacttttgttttttatagcgctctatcgatgtttcgataatggccgggtctgtatcggcaaattccttctgaatcgtttttgcgatgtctttggccggatggctttccacccattgctgggcgcgatagatggcgcgggtgaatttttccgccgtcttttcattgtttttcaaataactttcttttgccataaaggttgtgtatggcacttggccggaagcttctccgaaggatgcgacgatatgaccgatgccttctttttcaaattgggatgccgtcggttcaaacagctgcacataatcacccgttccggatgcgaatgcgttggaaatattggcgaaatcaatgttttgaacgaggttaatgtcttttttcggctctatgtgattctttttcaggacgtactcaccggccatttggggcatgccgccttttcgctggccgagaaatgtttttccttttaaatcgttccatttgaatgatttctcatccttccgcgacacgagaaatgtgccatccgtctgcgtcagctgcgcgaaattgatgaccggatcttttgctccctgcgcctccacgtaaatggatgtttcagaaccgaccagcgcgatgtctgacccgtttgacaaaagcgatgtcatcgttttgtctccgccccatgttgtttgaagtgacacttggagcccttcttttttaaagaaatcttttgcttcagcgacatacagaggcgtatagaagatggagtgtgtgacttccgccacctttaccttcgtcagactttcttcctgtctgcaagccggaagaatgagcaggaaaaaggcgcatatgacaaaaacgcagcccgctttgagccatttgttcacggtgtaacctccttgttttaagcgttaaaataaccttttctgctttacatatcgtatgatgggtataaaaaatgtgtgagtgcccatattcacgttgggaaagaataaaaaaactgatgatctaaggaggcgcattgttttgctggtagaaaagaaaaggttcccgtctccgagtccgcatgtccgcctctttgcggtatgctatgagtcagaagggctgaaggtaaaggggctccttgccgagcctgcggcgccgggaacatatgacggttttttatatttgcgcggcggcataaaaaatgtcggcatggtacgccccgggagaatcgttcaattcgcttcccaaggctttgtcgtgtttgcgccttattacagaggcaaccagggcggcgagggaaatgaagattttgcgggagaggacagagaggacgcgttttccgctttccgcctgcttcgggagcatccgaacgtcagggaagggcgggtgcatattttcggtttttcccggggcggaatcatggggcttttgaccgcgattgaaatggggcatcaagcggcttcactcgtttcatggggcggtgtgagcgatatggtgctgacttatgaagagcggaaggatatgcggcggatgatgaagcgggtgatcggcggcacgccgaaaaaggtgccggatgaatacagatggcgttcgccgtttgaaaaagcagaccgcattcaggcccctgtgctgctcatccatggagagaatgatgaaaatgtttcgatcgaacacgcccggatgatcgaggacaagctgaaagaggcggggaaaccggtggaaacttggtattacagcggttttacgcattattttccgccgcaggaaaacagacgcattgtccggcggctggcggaatggatgaagacacggtaagatgcctgatttatgatatgataataaagaataagagaatgaaaggggattttcattttgggaatgcctgttgaatttaataccatgattgtgacaaaaggcaatgaaaaacggatagaggaaaatatctttttattggagaaagagggctaccgcgtctatcctcttgatattccgatggacgtgcgcaaaacgaaaaccggcgagaaatccggcaccggcgaggtccagaagctcgaatgggcgaacggccggacaagcattacatacagactcacttcgcttcattcgacaaactgaaaaaacaaaagccgagggcataaacgcccttggcttttttgattacacgagaggtccgccggttttggcaatcgagtctgcatgggaaaactttttaaagttttctttaaactcattggctaaaaacagcgctttttcgttgtatgcttgtttatcgctccatgtgttttcaggctgaagaacttcatccggcacgcccggaacatgaacgggactgtgcaggccgaaaatgctgtctgccgtcatgtcagtctggttcagtctgccgtcaatagcggccttgaccatcgctcttgtatacgaaagtttcatccgttctccgactccgtaccctccgccggtccagcctgtgttgaccaggaagacttgaacgccgtgttcgtcgattttacgcccgagcatttcggcatatacatgcgccggaagcggaaggaacggtgaaccgaagcacgtcgagaaagtcgtttgcggagatgtcacgccgcgttcggttcccgcgagtttactggtgtatccgcttaagaagtgatacatcgcctgttccttcgtcagtttgctgatcggaggaagcacgccgaatgcgtccgccgttagaaagacgatcgcctgcggatggccggcaatgctcggctgcacgatattgccgatcatctcaatcggatatgcggctcttgtgttttccgtgtagaaggaattgtcgtaatccgcttcacccgttttttcatcaagcacgacattctcaagaacagacccgaagcggatcgcacgaaaaatctgcggttctttttcctcgctcagattgatacatttagcgtaacatccgccttcaatgttgaaaacgccggaatctgaccagccgtgctcgtcatctccgatcagtttgcggtccgcatcggctgaaagcgtcgttttccctgtgccggaaaggccgaaaaacagggcgacatcgcctttttcaccgacgttggctgagcagtgcatcggcagtatatcctgctgcggaagcaggaagttcataatggagaatattgattttttcatttctccggcgtattcggtgcccccgattaaaatgacgcgcttttcgaaagagacaatgataaatgtttccgaatgcgtgccgtccgtctccgggtctgctttaaaatgcggagctgagagaatggtgaaaggctgcgcttgcgggtctctttcatccgtttccggtctgataaacagctggcgcgcgaataaattgtgccacgcaaattcatttacgaccgtaatcggcagtctgtatttttcatccgctcccgcgaatccttcaaacacaaacagttcatcccgctgttttaagtagctgacgactttggcgtacagcttttcaaacgcctcttcagaaatgggctgattcaccgcgccccaatcaatttgattttctgtgctttgttcacggacgataaatttatctttaggtgaccggcctgtatatgcgccggtagtggcgcgtacggcgcccgttgatgtcagcgttccttcatttcggctgatcactttttcggtaagttttggagccgataaattatgatgcacattcggacttgcaagtaatgcttgaagatctgcggttaaatcaactaatttcataaaaaccttcctttgccggtttatttgtatttcgctgaatgtggaattagtataacatatatctgaaaatagtctatactatttacggttttttgtttgtgtttttccattgcttcccgaaataaaggcgcgcaatcgctttaattcatattgacactttccgcccttttacgataagatatttcattgagcggatactcttatcccgagctggcggagggacaggcccgatgaagcccagcaaccggtttctctgtaaaaaagcaggtgaaaacactgtgggaaaccaaggtgctaacctgatgcaaggtttaatattttccttgagcgataagagtgaaaggcacacagaccaaaccctttcctcgagtggaaaaggtttttttatttcataaaatatgccaattaacattctctgatatagtatgacattgtattaagagggagcgagttccgtatcatatgagaaggtcttgcaaaagatcttttttcaggaggaaaagtgaatgagtaaaaaccgtcgactatttacatctgaatctgttactgagggtcatccggacaaaatctgtgaccaaatttctgacagtatcttagatgagattttaaaaaatgacccgaacgcgcgcgtggcctgcgaaacatctgtaacgacaggacttgtgctggtaagcggagagattactacgtcaacatacgttgacattccgaaaacagtccgtgaaacgattaaagaaatcggctacacacgcgccaaatacggatttgatgcggagacttgcgctgttttaacatcaattgatgaacagtctgcggatatcgcaatgggtgtcgatcaggcacttgaagcgcgtgaaggcacaatgagcgatgctgaaatcgaagcaatcggagcgggagaccaaggcctgatgtttggttatgcgtgtaacgaaacgaaagagcttatgccgcttccgatctctttggcgcataaactagcccgccgtttgagcgaagtccgcaaagaagacattcttccgtaccttcgccctgacggcaaaacgcaagttaccgttgaatatgatgaaaacaacaagccggtccgcatcgacgcgatcgttatttcaactcagcaccacccggaaattacgcttgagcagattcagcgcaatctgaaagagcatgtcattaaccctgtcgtgcctgaggaactgatcgatgaagaaacaaaatacttcatcaaccctacgggacgtttcgtaatcggcgggcctcaaggtgatgcgggtcttacgggccgtaaaatcatcgttgacacatacggcggatatgcacgtcacggcggcggcgcattctccggtaaggatgcgacgaaggtagaccgttcagcggcatacgctgcgagatacgtagcgaaaaacatcgtggcagcaggtcttgctgattcttgtgaagtgcagcttgcatacgcaatcggcgtggcacagcctgtttctatttccatcaatacatttgatacaggaaaagcttctgaagaaaaactgatcgaagtcgtacggaataacttcgacctgagacctgccggcattattaaaatgcttgatctgcgccgcccgatctataagcagacagctgcttacggccacttcggacgtcatgatgtggatcttccttgggagcgtactgacaaggcggatgcgcttcgcaaagaagcactaggagaataattttatagccgcttacttaagcggctttccctttttgtagatgctgccatgcttattttttacatagcgtgaaaccaatggcgtaacaaagcgtctataaaaagggggtccaattagaaaattacacttatggaggctatactatgtgtggatttgtcggtgtttttaataagcatccattaactcaaaccgcagatcaagaagagctaatcaaacaaatgaaccaaatgatcgttcaccgcggtcctgacagcgatgggtattatcatgacgagcacgtcggattcggcttcagacggctcagtattattgacgtagaaaacggcggacagcctttatcatatgaagacgaaaaatattggatcatttttaacggcgaaatctataactacattgaattgagagaagagcttgaagcgaaaggctacactttcaatacagattccgataccgaagtgctccttgcgacataccgtcattataaagaagaagccgcttcaaagcttcgcggaatgtttgcgtttttaatctggaacaaagctgaccgcgtcatgtacggcgcgagagacccgttcggaattaaaccgctgtattacacaaccatcggggacaaagtatattttgcatctgaaagaaagagtttaatggccgctcaaaacggtattgatcttgatacagcttctttacagcaatatatgtctttccaattcgttcctgaaccgagcacgcttgacgctgaagtgaaaaaagtcgagccgggcagccagtttacgatccgcccggaaggcgacatcgcgtttaaaacatatttcaaagcgaacttcaagcctgttcagtctgatgaagataaattggtgaaagaagtcagagacgcaatctttgactctgtcaaagttcacatgagaagtgacgttcctgtcggttcgtttctatccggcggtatcgactcttcttttatcgtttcagttgcgaaagaatttcacccgagccttaaaacattttccgtcggttttgagcagcagggctttagtgaggttgacgtagcgaaggaaacggctgccgcgcttggtattgaaaatatcagcaaagtcatttctcctgaggagtatatgaacgagcttccgaaaatcgtctggcactttgatgacccgcttgcagatccggcggcgattcctttgtactttgtcgcgaaagaagcgaaaaagcatgtaacggtcgcgttatccggggaaggcgcggacgagctgttcggcgggtacaatatttaccgcgaaccgctttcgcttaaaccgtttgaacgcattccgtccggtctgaaaaaaatgcttcttcatgtggcgtccgtcatgcctgaaggaatgagagggaaaagcctcttagtccgcggctgcacaccgcttgaggagcgctatatcggtaatgcgaagatttttgaagagcccgtgaaaaaacagctgctcaaacattacaatccagagctttcataccgtgatgtcacgaagccgtactttacggaaagccgttcatacagcgacataaataaaatgcagtatgttgacatccatacgtggatgcgcggcgacatcctgttaaaggctgacaaaatgacgatggccaactcattggaactgcgcgtgccgttccttgataaagtcgtgtttgacgtagcttcaaaaattccggatgaattgaaaacgaaaaacggcacgacgaaataccttctgcgcaaagctgctgaaggggtagtgcctgatcatgtgcttaaccgcaaaaaactcggcttccctgtgccgatccgccactggctgaaaaatgaaatgaacgaatgggttcgcaacatcattcgcgaaagtgaaacagacgcttatattgaaaaggattatgtccttcagcttctggaagatcattgtgccgacagagcggacaacagccgcaaaatctggaccgtgctgatcttcatgatctggcacagcatcaatgtcgaaaaaagactggtgccggaagagctgaatcatcagccgaaagaagtcattttcgtttaatccaaaaggctttcgagttatcgaaagccttttttctattgttttttgtaaaccgtctattccgctctgttttcgacaaagtattacgcaatattcagaaaaaggttataataggactaatcgggtagattccggaaaaagttttctggctatttcgtctcggtttgttgtttctttgtcaaaatcagggggagggagagttatgcaaaacaaagaaaaaacgcttcaccgcggcttggaagagcggcatatctcgcttatgtcgttgggcgccgcgattggagtcgggctgtttctcgggtctgcttctgccataaagcttgccgggccggggattttagccgcttacgcctgcagcggactgattatgttttttattatgcgggcattgggggaaatggcgattcaaaagcctgtagccggttcattcagccggtatgccagagattatatcggcccgcttgccgggtttttaacaggctggaattattggtttttatgggtcgttacctgcatggcggaaatcaccgcggtcggcatttatatgggctactggttccctgacgtgccgtcatggatctgggcgctttgtgcactcgtcattatgacggctgtcaactttctggcggtcaaagcgtacggtgagcttgaattctggtttgcgctcattaaagtcttggcgattctgtcaatgatcgcgatcggtctggtgatgatcgtattcggtctcggaaacggaggcgttgcgctcggaatcagcaatttatggagccacggcggctttttcccgaatgggattaaaggggtgctgctgtcgcttcagatggtcatgtttgcttatctcgggattgagctgatcggtgtcacagccggtgaggtcaaaaatccggaaaaatcactggcgcgggccatagatactgttttttggcgcattctcattttttacgtcggagctttgtttgtcattatgtcaatttatccgtggcaggaaatcggttcaggcggaagcccgtttgttttgacatttgaaaaaatcggaatacccgctgcagccggaatcattaattttgtcgtattgacggcggctctttcttcctgcaacagcgggatcttcagcacggggcgtatgctgttcaatctggcggagcaaaatgaagcgcctaaagcatacggtacggtcacaaaaggcggtgtgccgggaaaagcggtattggtttcagcgggtgcgttatgcatcggcgttttgctgaactacgtggtgccggcgaaagtgtttacgtgggtgacgagcattgcgacgttcggagcaatttggacatggtcgattattttgctttcccaaatgaaataccgtaaaagcttacagccggaagaacggaaaaaactcaaatataaaatgcctttataccccttttcctcatatatctcgctggcatttctggcttttgtcgttgtgctgatggcttttgatgcagagaccagggtggccgtcatcatcggtcctgtctggttcggcatattattagccgcctattacggcaaaggattccataaaagaaaagacatagatctggaaaacggacagacattcgccgaaaaagcgtaaaaaagagcccgctgaaatgggctcttttttcataggatcgggtaaaagggggaagaataaaacaaattcctgaacattttgcttctgtttcctgacaatcgggagaatgcaaatggtttttacttaaataatattttgaaaaatggtacagtagtaaaacaaagctgatcttttttatttctcttgcattgttttatagtatcggcctttttcaacatattccgttctgattctttccatgtcccgtatgtcttcttctgtcagccggcggataacctttgcgggccggccgaacgcaagacagccgggaggaatggttttgcccggaggaacgagacttccggcgccgataaacgcgccttctccgatttccgccccgtcaagaatgacggagcccataccgattaaagcattctttctgatgattgcgctgtgcagtgtaacctgatggccgatcgtgacgtcatcttcaataagaagcgggcggttcgggctttgatgcagacagctcaagtcttgtatgctgactctttttccgatccttgtcggcgcaacatcccccggatgactgccgagaaccaaatgctcgattgttctccgatcacgacgtcgcccgttatgacggcgttatccgcaatgaacgcttcaggatgtacgtcaggcgtaaattgtttataagggtagattatcatgtctcatccttctttctctaaatttatgtaagaggtgaactgcatgtggacttggaaagcagacaggcccgtcggtaccattgtcattatccacggggcgagcgaataccacgggcgttataaatggctcgttgaaatgtggagatcttccggatataacgtggtgatgggcgatttgcccggtcagggaacgtcgacccgcgcccgagggcatattcgctctttccaagaatacattgatgaagtagatatatggattgataaagcgagaacgcttgaagcgcccgttttccttttgggccacagcatgggcggactgattgcgatagaatggtttaagcagcagagaaatccccgcattacggcactcattttatcatcaccttgtctgggtctgcaaataaaagtcaataaagtccttgattttgcgtctaaaggactgaacgtcctcgctccgtccctcagagtggattccggcttatcacctgatatggcaacgaggaatgcggatatgattgaagcggatcaaaacgattctttatatgtcacgaaggtatccgtaagatggtacagagagcttttaaaaaccattgatgccgctatggtgccgactgatgcgtttttaaaggtgccgcttttgcttatgcagggcggtgatgacaaaatcgtcgataaaatgaaagtccgcaaatggttttccggtgtggcttcccataataaatcgtaccgggaatgggaagggctttatcatgaaatatttaatgaacctgaaagagaaactgtgtttaaggcggcaaaagcctttacagatcagtatatttgaattcgctgggggtgcatatgttgacagtaccggaacatccttttaaccttatggcaaaagtgtatcgggaaatttttccgctcgttcatcaggaattgaacatgtggcgggaaaaatcagattccattaaaaataccgaactgcggcagcaggcggccgcaagtatccgcgataagtcgtttcattgtgaaggaggcggcattttagccctgctttcgggagagcagaaacagaaatgcgtgcaatttatcatcgcgtatcagacaatcagtgattatctggacaatctgtgcgaccgcagcacctcgcttgatccggaggacttccgcatgcttcatctttccatgcgtgacgcgctgacggtcggtgccgaggtgcggccgtactatcagtacagagaggagcgggatgacggcggttatcttcatgaactggtcagaacatgccagcgggtgctcgggtcaatagaacattacggtatcattaaaccttatttgcttgaactgtgtgattattattgcgatcttcaggttcataagcatgtcgttgagcatgaacgggttccgaggcttaaagcctggtttgagcagtacaggtcgcagcttccggaaatggagtggtttgaattctcggcctgcgccggatcgacgttaggcattttctgtctcgttgcttactcattccagcctgattttaacgaacataccgctgagaaaatccgcagcagttattttccgtacatacaaggcctgcatatactgcttgattatttaattgaccaggaagaagatctgcttgaaggcgatctgaatttctgtacgtattatcagtctcatgaagaaatgatgcagagactgcagcattttattgaaaaagcggatgaacatttgcaaggcattccgcatgaaaattttcaccggctgatcaacagggggctgctcggcgtctatttatccgatgacaaagtcgccggccaaaaagaaatgggccgcctcgcgcgaaagctgatcagggcaagcggaaaaacgtcatttttcttttatatcaacggaagagcctaccgcaaatttcagaagatggcttggacgaaaagttcgtaatgggtgaactgcgcctctcgtgtacatcatgacggcgcagttttttatttatgatgtgaagaatgaaacattgtgtgcgcctgcagaatatgatactttaattttatgaaaaaattaaagtatttagcggtcatagcattactttccatttccggaggctgctccgtcacccatgcttccgccggctatcatcctgtcttgatagcgcacaggggctcttctgcgattgagccggaacataccgctttgtcttatgcacgtgcgattaaagacaaagcagattatattgagatagacttacgggagacgaaggacggccgtctgattgcaattcacgataaaacggtagaccggacaacagatggtaaagggatgacagatgatctgtctttggctcagattaagaaactgaatgcgggaaaaggagaaaagattttaacattagaagaaatcatacagaaattcggacaaactgccaattactatattgagacaagagaaagcaacggcagcctggtgatggaaaagaaactgattgacatattacaaaaacataagctgatttccggccataaagcagtcattgagtcttttagcgggaagagcttaaagaaagttcgttctatgaataaaaaagttcctcttgttcgattattaaaagataacgaggctgaggagataaatgataagcagctgcaaaccatcagaacgtatgctgatacagtcgggatcaacgccaaattggcaaatgaagcagtcgtgaagcgcattcatcacaataagatgaaagtgcacgtgttttttgataaggaagacgagcatacgctgacgcctattatgctgaaacaaaaagcagatggtgtctttacgaacaatcccgcttatacacgcagcgtgctgcaaaacagtaaataaaaagagacatgcgcattttacgctgtctctttttttaacggtttcttttttgccgcaaggtgcattgcgaatttgccgatcagcccgatgacaaaaaatgcagcaaaccaccagtaataggttttcgcgaactcaaatcctaaatgtcttgataaaatgatgacaaacatcacatagggaacacttgaaaatatgatgcgaagaatattcaaattgccgctcctcccagatgttacacttaaaagatgaacttttttccattatttcatagtaattgatttttcttgaaaagtaaatacaaaaagaatcggcccgcttatgacaggccgattctttatttgccggcagatttcttttcaatcgctataataaacggcgggtcgttttgctggttgagaaagccgtagctcagcacgcgggctttttcctgatcaagattgctgcagtattccagtaatgcacttttttccgtcttgccttcaggatgcccgtggtacacaacgagaacgatcagcccgttctccttcagcagttcaaggagctgttcgatcgcggaaatggttgagtgaccgtttgtcgtaatgcttttatcgccgcctggcagatagccgagattaaagacggcgcaagccacacgaccgtgcgcatcttcaggcagcgatgcctttatttgatcatggcttttatggtgaagcgtgacgcgcgggccgaagtcggcaccgagccgctccttcgttttagcgagtgcgtccgcttgaatatcaaaggcatggacatgtcctgtctcaccgacaaggccggccagaaaatatgtatcatgtccgttgcccatcgtcgcgtcaaccgtgatatcaccttcctgtgcggcggacttcagcaattctttactgaaagggaggatgtgcatcaaggtcatagggcggtctcctccccggtctttctgaagagctttccttgatagcttccccgtgtttccagctctttttgaatggcgcccagtacttcccacttattgacgctccacatcggcccgaccattaattcgattggcccgtctcccgtaatgcggtgaacgatcatttccgggggaatgatttcgagctgatcacatacaagacttacatattcttcttgagaaaggaactccagctttcctttttcatattgcttcaccatcggtgtgccttttaataagtgaagcaggtgaattttaatgccttgcacatccaaatcagcgacggctttggccgtctccatcatcatgtccctgttttcaagcggaagcccgttaatgatatgggaacaaacgcggatgccgtgttttctcagtttattgacaccctcaacatagcagtcaaaatcatgggcgcggttgatcaggagtgcggtccgttcatgcacggtctgcagcccgagttcaacccacaaataggtccgctcattcagttctgccaaatattccacgacatcgtccggcaggcagtccggacgggtcgcgatagacatgccgacaacgccgtcaagcttgaggacggattcaaatttttcacgcagctcctctaccggggcatgcgtattcgtgaacgcctggaaatatgcgatatatttaccgtctttccacttttcgtgcatacggtttttgatatcgtgaaattgcgtgagtaagtcatcggcccggttgccggcaaaatcgccggagcccgccgcgctgcagaatgtgcagccgccgtgtgcaaccgtgccgtcccgattcgggcagtcaaaaccgccgtcaagcgcgactttaaacactttatgcccgaaatgctcccgcagatgataatttaatgtatggtaccgtttttccgtatttgaataaggaaaagggttattctcgttcaatgttcaaaaagcctccctcacatcagatgcatcctaaaattgtagcatgaatgatggggcggaacaatgaaacaattatggaacggtcaaggcgtaatatctacctggtttttctgttgttgttttaatcgttttggagaaatatcactgaacaatgcaaaaataattcctaaaataagaattacactgcctactttgaatgtattattaaaactgtcacttattttttcattatataaatttgaaatttttttctggatagcgataacttccttcttttgagtattgaaacttttttgtaccttttctttatatggatccggggttatagaaagaatttcttcctcttttttgtttaattcagcaatactttttcttcgatcgaaacctttactgtctgaatgctttaagtgagttattatctcgttttttgcatttttatcaaaaacctgattgttttccacaattgttatggcttctttttttgcagaagctgtgtgatcatttatattcattgtaagcacagatgtaagtatggcaatgcctagcgcttgtccaactgtccgcatcatattaagaatacctgaggcaatacctactttctcaggaggaataagccgtatccctgaactcattgccggtcctatcacaagccctaaagctaagccggtcaaacataacagaataactaccgttgttacagaactgtcgtatcgtatgtatccatataaatatgttgtgattgttaaaccgagcatacctagacccgaaagccaaatgcccccgagtttatcagatagctttccagaaagtacagaggtaaacatagatgatagagctaatgtagaaacaattaaccccgcttctaattcagtttttcccattaaattcgtgaggagtaaagtaataataagggtaccgcttgttaatccaaggccctgcataaagagggtgaaagaactgaaactaaacgtacgtatcttcagcatggataagggaatcatcgggtttttaattttagattcaataaagaaaaacaaacagaataataatacagagattacaaaaagagagataattaatggtgatgaccagcctaaatcagatacttttgcaaagccaaaggttaaacagaagagagctccggataaaataagaatccccatgtaatcaatttttttactcactgtttcatcataactctcagtaataaaaaatgctgctaaaaaaagagaaatcaggcctaaaggaatatttatgaagaagatagcttgccaattaaaattttcagttaataatcctccaagtacaggtcctaaagtagctgctaatcctgagaaagccccccagattccaatgatcaatccttttttattttgaggaacgatggccaaagcaataggcattgtaactggcacaatgaaagcagcagataatccctgaatcactctaattgtgataagcatttcaattgaagtgctcaaacaggcaataactgatgtcaaaataaaaagtgctaatccaaacataaaagctttttttcttccaaaatggtctgccagctttgatgcacctactaataaaactgcaaaagctaaagtataacctgtagccacccaagctacttgagaaaggttgctcgaaaagtaatccagcatcttaggtaatgcaatatttactatagtggtgtccattaccgaaatgaatgtacctaataataatgcagataacataattaattttttgaaattcaaaactacaacctccatcagatattaatctaaattaaaattcgatatatatctaaaaacatgataaatgcaatcttaagaggtgtcaatattattcataaattgttttttcatccacttatctcgaaatcatatttttataattcaacaattttgtaacttgaaataactcaataagagcttaaatggacctgtaaactagctgagatgattaaggatttctgaagagtatgacatgaggagaatacttagcatgaggtgaagcaagtctaataaatctaggactgctcatgataatgctcagtcaggtaagtgctaattagaaatgaatattctttgaaagtttccttttgattgataatattaaaaatgtaaaatgtctggcatgaagatagtacaacgttttcctttgtggaaaaagactttatggggtgtgaaaaagtgcggttaataataaatgacagtgtttcagaattctttgacaagatatcctctattctattcttaaaacacgaggaattcttcaaagattatacaaccaaattgggtttgaatttagataatgaatattttgtattattagatgatcttaaaagaataaaagagttagatagtgagtttttaaatttttattttggcagcttttgcgactacaaagatgttaggaatgcaaatattttttgtttagccacaacattttttaaaataccacaaatttacacgaaagatttttttgaaattattgattatttgtctgcagttacagaagaagagataagaaaaaatattttagagtctctaatttatttacaaggagatcttaaaaccgaaacatctacccaacagtatttaaatgatagggaaagtttatttgagctacttaataatctaaatataaagcccgaatacaagtggatcatatttaaggtaatgaaatctcctaaaacttatgtagatcaattttgcaataaattaatgttggtgaatggttatcttaacgaggcgatttataatttaattaaattcagagatgagtggatgaatcaattaaaaaacataaatatagattttccaaaaaagataatcagtacgttaaaaggtaaggaatacttatcttgtaattatattaatatatatccaacacttttaccttgcactgcaactattacgaaaagtgaagataacatttatgttggactgggttataaagttgataaaatatttgaaaatacattagagaaagcagagattaatcatatcattgattttttgaagcttttatcggataaaagtaagttcaagatattaatcttacttagtcataaaaaaatgtatgctaatgagattgctgaacagctaaatttaaccaacgcaacgatttcacatcatatgagaattttgacattgcaaggtttagttgagagtacgagaaatcaaaataaaacatactattatcttaattcttcaaaattcgattcacttttgaacggtttgttgaaaaaatttaaagctgttccagtcttagatggggatgagtaagttttatagttggtgttagtttcgggatgataattaaagctaataaaaacagatctaaaaaatttgatgaatcccgggtgttttacacaaaaaagataatttaatggtgaacaatttaaagcgaaccgaagatcttgtgggtgatgtggaaaaattatgatgtttttaataaaagaagaattaagttatcgttctaaaatgaaggatttttataaagacttcattctgtcttgattaagttttacatttaatcgtattttatgccatctctgtcttgtgaatgaattacctgatatttcttgtgagaattaatttggaataagaaatactattgatatgacattatcaataggaggactgtttaatggcaacaagacaatcagtagatgaacatctccaaagaagcgaacaggcatatgaatttgcgaatgagcaatttatgaccgcttcaaaacaagagcattataatgataatgagtacagtgaagcgcaaatgatgcttgaaaacgcggtgaatgaattaaacaagctgtcattatctgcgaatgatcagcaaagagagcagctttaccgaatgagattgcagctgcagaccttgcaaaacaacatgattttgcagcgtaattttgattactgaccgcgccgtttcaaatggttcagcaaacctgccggaatcccggcgggtttttttgtatttttttaaaaaaagaattgacaataggcctgagtgtgtttattgtattacgtgtactacttgatgtaatacacataaaacactcgaaaaatgaatcgacatataaatgttaagcatagggaaggggaactttcatgaaaaacaaaagatccgtaaaacaagatgtgcctcttattatcgccgcttcggttttggccagcagtctgtttgtcgttcttgtcgtcatcggttttcaatggcagaacatttaaagaaagagagcagctcgtaaaagaaagaagggaagtaaatgattcaaatcgatccgagaagctcaactccgatttatgagcagatcatacagcaattgaaagagctttgtttaaaagggatcatgaagccgggggataaacttccttctgtcagggaattggcaacgatcattatcgccaatccgaacacagtcagcaaagcgtacaaggagctcgaacgcgatggtgtcattgaaacgctgaggggaagaggaacgtatatatcggagaatgcaaaaacgacattggttgaagggaagatgacgatgataaaagagcaattgaaacagctcatcatcgatgcccattacgcgggagttgagctggagaagctgcaggaatggataaaggaaatcagcgctgatgtgaaaggaggaaaggatcatgattgaattgcggaatctctcaaaaacgatagacggtaaagaagtgctcaaggatatttcgctcaccatcggaaaaggggaaattttcgggctgctcgggcggaacggatcagggaaaacaacactgctccggctcattcagcagattctgcttccggatcaagggacggttttatttaatcaggtggaaataaagcgtcatccgaaagtcaaacagaacattatttatatgcctgttgaaaatcctttttatgacaagtatacatataaacagcttgttgcgattgtaagcagaatctatccgaattttgatgtgacttacgccaatgagctgatgaacaggtacggcattccggaaacgaagaaataccgtgaattatccacaggcctgaaaaaacagcttgcgctcgtccttgcctttgcttcacgcccggctcttatccttttggatgaaccgacggacggaattgacgccgtaacgcgtcatgacgtgctgcagcttatggtggatgaagtagctgaacgggaaacgagcattctgattacctcacaccgtttagaagatattgagcgaatgtgcaaccggatcgggtttttggaaggaaatcagctgacgaatgtgatggacttggatgatatgaaggaagagtacatgaaaatccaaatggcatttgaagaggacgtcgccttgaagatcagagaacaaaatataccgattctcgaccatgccggtgtgttttatacggtgctgattcaaaagaacgatgagaagaaaaagaactttctgcaagagctgcagccgaaagtatggaacgaacttcctgtgaacttagaagaagttttcatcgcgaagtttggaggggaccggagatggtagacaggggattgctgtacagggaatgggtgcagaatcgaactgttcttgtgatggtcggcatttttttagcggcggtcaatccatttgaagtgttaaatacctatctggtttatcaaggctgtctggacacccacgaagcatattgtaagttttatgtgaattctttggatagcggaatgctgaacttaaactgggcgcccgctgtgattttggcggtttgcttattcggactggaacgtacgaaaggaacgattgatgcgcttttcagtctgccttattcccgcgctcaggtgtttcacactaaattttggctcggagcggcggtcattaccggcgctcaggtgatcggctacgggctggctgagctgctcattcttctgttaaagcctgagcgcgtatatttcttccaccattacagcgtcggagagattattgtgagtgttttggcttttacattggtcgcgagcgcaggctgcttaacggggaatacgttcgcccagctgttaacggcgtttgccgtgtcgatagcgccttacctgattattacgttgccgctgacaaatgcggaagttatcttcagggtcggcatgcatgagctgatgccatcagtcaatgcttacctaaacgattcgtttcaatatctgattccgatcatgtatgttaatacggactgggtatctgccagcaagtatatattaatcattccggcagtgatgagcattgtattttatgccatcgggtacttttgctatgtcaggcagccggtggaacggaacggccgtttttttctttggagacagcttgaccggcccattcagattgtggtgatcatcatcgccgttctcggttttggcctggcggggtactcgacgggacatacgatgacagggtatgtggccgggatgctggtcggaggagcgatcggatttttggtcagttattttgtgatttataaaaaaacgaagcatgtgtaagagaggaggaccggaatgataccgcggggattgttgtacacagaatggaaaaaaaatcagtggttgtttttatgcagcggcattcttttaatggcggcaaacccttttatggtttataacaactactcaacatatcaagaatgtttgaataacccagctcttcaagattgtgaattcgttgtcaattatacgaatgggtcgcctctttccttcagctgggttgtgagtgtcatcattgctgtcttcttattaggcttggaacggacaaagggaacgatggatgctttgttaagcatgccttacagcagaggccaaatctttcagacgaaattctggctcggcggggcagtcattgttgctcctcaggcgataggctatggagcggcgtcattgctgatatctttgttgaaaccgagccatacgtacgattttgatcatttttcaatcggaatgattgtcatcagctttatggcttacgccttgttaatggcatccggagcaataacgggacatatattcgcccagctgttaacggcgtttacagtaacggttctgccctttttactcatcggtctgccggccgcgaatttggaggtcgttttcgattttagtgtcggagatcaattttcttttatcagcagttatatcgaatcccgtctttttatatttataacccctattggatatgtgtttaacgactggatcagagaaagagatttgattttaatcattccgattgtgatgagccttgtcttttatctgatcggttacgtcagctttctgaaacatccgaatgaacggaacggcagattctttctttggagaaaattggaccggccggtgcagatcttggtgattgcgtttgccgttatgggtttcggcgttttcggatatggggtcacagacacgatgttcggctatttagccggcattatcttcggcgcggttatcgggtttttcatcagttattttacggtttacagacagtcaaagcatatgtagatccgtttgaaaatgagcagtttggaggaaggcaaggtgccgattagcggtttgctttataaagaatgtaagcagcggcagacgctgctgctgcttacagcggggttcttatctatcttaggccctttggcaattataaatgagtattttcactataaggattgtttacgtgcacttcagctgtacccggggtcagtttgtacattcagcatcgattacagcaattatcggaatttgattgggcttcatttcattccgccggttgttatggggctttttctgataagagcaggccgggctgaaaggatgtttacactgagtcttccgtattcgagaagccggatatttcatacgaagtttttcttgggagcagccgtgttagccggctcgcagtttgtttcttacggagtatccgacatattgttcctagcgcttaaacctgacgctgtccatcattttcaatcattcagcgcagggatgctggtcatcagcttgatgatttacgcattagtgacagctgccggcacgataacgggcaatttagcggcgcagctgatcacagcgttcacggtttccgtctttccgatcgtggttatgacgatttatctgttaaacgccgagttcctttttggcaggcaggctgtgccggatattgatttcccttggagcggatttctgatctatttcatgcctgccgcttacatccatacatcatggatgtattacatgaaacacgcattgttcatctccgcattaatgggattttgtttctatctattcggctatgtgaatttcctgaaaatgccgaatgaacgaagcggacattttatcctgagcaaacacattgaacgcatcattcaagtgctcgtcatgtcgctcagtatgctgggaagtgcgggggtatgcggatatgcttataacggttcgtataccggttacatattcggcatgctcatcggtgcgattatcgggtttttcatcagttattacttcatctataaaaaaacgaaacagatataagggggagtggtgtacgtgatagaggtacagcatatcgatcattcatttaaaatcggcaggaaaggcagagagagtgaggttccggtactgaaggatgtctctttgaccgttgaaaaaggggaaattgcctgtatcgtcgggcggagcggttccggaaaatcaacgcttctgaatttaatttcgggatacatagcgccgacaaagggccgtatcgtcattaacggcactgatgtgacgggtttcaatgaaaaagagtgggcgcagttccgcctcgggcatttcggctttatttttcaaagctttcagctcatcccgagtctgacaacctatgaaaatgttgaaatgccgcttgccttaaaaggtgtcaaaccgtctgaacgcaagcagaaagtcgcggatatgctgaaacgggtcggacttgaaaatcatgcgaatcattatccgaatgagctgtcaggcggccagcagcagcgtgtcagtatcgcaagagccctcattttaaatccgtcaattattttagccgatgagccgacgggaagcctcgattcagaaacggaacttgaggtgcttgcattaattcagcagctgaaccgggagcgcgggattacatttgtcatcattacgcatgacgatgaagtcgcttcgatcgcgcattcaaaattccagctgcatgacggtgtattaaaagggggcgttactgttgagatttaaggatcagattcactttatcagaagaaatatgaagaaaaaccggctgcgtgttttcatgacggtgctggcgacgacaatggcgtgcgcgtttttagtggtgctggcttccgtcggattcggcatccaaaaaacgattacagacattacgatgagccagcagattgttacggaaatcaatgtgctcggccaagagaacggaaaagccgtgaagaaatcagacttggaaaagtataaaaatgtcaagtctgtcgttgagagaacacaagtgtatgaaccgaacaaagcgtcattgggaaaccgaacaaatgaagattcagccattgtgctgacaaacatgaaagatgaagtcaaagccaatatggagcttgatcagggaagagtcgcccgtacagagaatgaaatcgtggtcggctatgattttgcgaagaacctattgacgaaaaaagaggctgacgcttacgacaaagagttaaaggatcaccaaggcgacatgtcggaggtgaaaaaaccaaaaggctatacgaaagacctgcttaataaaacgatacagctgagcatctccaaaacaaacaaagacggagacgttgaaaaaacgaaaacgtacgacttcaaagtagtcggaattacaaaaaaaccgtcccaagattggatggaggatacaaatatttttgtgagtgatcaattcaagaaagacttctcgacattcttggatctgaagaatggaaatgcggaaaaaagcatcaatgtgtatgcggacaaattcgatcatgtcgatcagcttacccatgacctcacggatgacggcttttatgtcagatctgtcacaaccgagctgaagggcgtcaacacctttttcctcgtctttaaaatcggtctgatctttgtcggctttatcgccgtcgtgatttcagccatcggtattttcaatacgatgacgatggcggtgacggaacgaacgcaggaaatcgggattatgaaagcgatcggcgcaagcccgtccatcatccgcagaatgttcctgatggaaagcgcctatatcgggatattaggttctgtcatcgggattatcatttcttacggagtgagttttgccgtcaatctggctgtgccggttattttgaaagcggtagggggaaataccggagctgaagatcttcattataccttctcctacatcccgctcagcctcgttgtgatcgcagttgtcatttgtgcgggggtcgcggtgatttccggtatgaatccggcccgcaaagcgacaaaaaccaacgttctgaccgcattaagaagagaactgtaaaggaaaaaagccggctggacatcagccggtttttcctctatctatcagaaaagggcggataccatgtttcacattttgttaatagaagatgataacactttgtttcacgagatgaaggagagattaacgggctggtcatttgcggtgcacggaataaaggatttcagccgggtcatccgggagtttactgaaattaagcctgatttggtgatcattgatgtacagctgccgaaatttgacggctttcattggtgcagaatgatacgctcccaatcaaacgtgccgattctctttttgtcctcgcgcgatcatcccgcggatatggtcatgtcgatgcagctcggggcagatgattttattcagaagccttttcactttgatgtgttaatcgcgaaaatacaggcggtgttccgccgtgtgcaccaatacggcacagaaccggcgctgatgaaaagatggtgcggggcggtcattgacacagaaaccaacacggtcagctgtaaaaacggttcggtcgaactgaccaaaaacgaaatgctgatcttaaaactgctggctgagcagaaaaataaaatcgtcagccgggaagaactcatcagaagcctatggaatgatgagcgtttcgtcagtgataatacgctgacggtgaatgtcaaccggctgcggaaaaaactcgatcaattaggcatcgggaaaatgattgaaaccaaggtggggcagggatacatcgcaaaggaagaagacggtctttatgattaaatcatttctgctcgaaagaaaaagctggatcgcgatgtttcttttgcagcaggctgtgctcctttttgcggcatatattgatgcgtctattccgtttttttcggtgctgtattttgtttacctgtcgcttcttgtgtttcttgtatttctcttgttccgctatcgtaaagagaccgcctattataaaagcttaagagagtgggacgccaatttagacatgtcttatcttaaagcgcctgacagtccgtttgagtctatcgttgaagaaagcattgaagggcagacagagcaattacgaaaaagctcacttgatcttcaggcggcgtcagagcatgaaaaggatgatctgatgtcatggattcacgaggtcaaaacaccgctgacagcgatgcatctcatgatcgagcgccttgatgaacagccgctgaaagcccctttgctgtatgaatggctgcggattcaccatctcctggaccagcagcttcatcagaaacgattgtcctttattgaaaatgatttatcattccagcgcattcagctcagaccgctcgttttcaaagaaattaaaaacctgcaatcatggtgcatacaaaaagggatcgggtttgacattcagcttgattcaccggacgttcacagtgacggaaaatggctttccttcatcatcaggcagctgttaagcaatgccgtcaaatacagtgaagcggatgacattaccgtaaaaagctatgaacaaaacggccgggtgcatgtcgatatcgaagaccgcggcatcggcatcgagcccaaagatcttccgcgcatttttgaaaaaggatttacctcgacgcgaatgaggcgagatcacgcgtcaacggggatgggcctgtatttggctcgaaaagccgcggctccgcttctcatccagatcagcgtgcgctctgagccggaaagcggcacgatttttaccttggtgtttccaaaacagaacgatgccgtcagcatgttcagcgtgtgacaaaagtgtcacatgcttttctcttttgttcgcttaatcaaacgaaaaaaacggcttctgtttttaaaataaagataaccaatgtaaaaggagaatcataacgtgatgattttagaagcaggcaatatccaaaaaagctacggaaacaagctgaataaacaagaggtgctgaaaggaattgatcttcagattcacaaaggggaattcgtcagcattatgggcccgtcaggatcagggaaaacgacccttttgaatgtgctttcctccattgataaagtgagctcgggcaccattaaactgaacgagacggagattacatccatgaaagaaaaacagcttgccgaattcagaaaacggcatctcggctttatttttcaggattataatttattggacacgctgaccgtgaaggaaaacatactcctgccgttatccattacgaaaatgtctaagaaagaggcggacctgcgatttgccgagacggcagaggagcttgggatctatgatttgagacataagtatccgagtgaaatttccggcggacaaaaacagcggacgtctgccgcaagagctgttattcacgagccgggcattatttttgctgatgagccgaccggagcgctcgattcaaaggctgccacggatttattgaataaactcagccgcctgaatcaaaaacgccgcgccaccattgtgatggtgacgcatgatccggttgccgccagctattccggacgtgtggttttcattaaagacggccgtgtgtatacgcagctgaataaaggcggtcaggacagaccggacttttttcaggatattatgaaaacgcaaagtgtattgggcggggttcaggcatgagtattcatcatttgatcttccagaacctgaaaaagaatatgaaaaactattatctttacgtttttgcgctggtgttcagcgccgccctttatttcgcgtttgtcacgatgcaatacgatccggcgcttgatgaaatgaaaagctccataaaaggagcggcggcaatccgggccgcctctgtactgcttgtggcgatcgtgtcggtatttcttttatatgccaacaccatttttattaaacggcgcggccgggaaatcggcttattccgattaatcgggatgacgaaaatgcacattttccgcatactcagcgcagaaaatttcattttgtatttcggatcgatttggatcggtattttcgccggcttttccctctcgaaattatgtatgatgatgctgtttcatacagtcggtgtgaaagcctctgtctcactgtttttttcaagcaaggcgctcgttcagacgttaattgtgttcggggcaatttacgtgctgattatgatgatgaattacttatttattaaacggcaaagcattttgtctttatttaaaaccgcgtcatcgtcagaaagcggcataagacggctttcttgggtgcagatgttgatcggcgttgtcggtattgcggccattatcgccggctatgccgtgtccgcggatttattcggaggcagttttacgagcatgaatgaactgttttcggccatggtgtttattctcggctcggtcattatcggaacctatctgttttataaaggttcggtcagctttctggcaaatctcatccggaaatcaaaaggcgggtatctgaatgtcagtgaagtgctgtctttgtcatccatcatgttccggatgaagtcaaacgccgtattgctgacgattattacgactctttcggcgctggcaatcggtttgctgtctttaagctatatctcgtactactccgcggaaaaatcggctgagcaaaatacagccgcggactttgcgtttgataaccaaaaggagactgactcttttaccgctttattgaagaaaaacggaattgaacacaaagtaaaaacaatcaagaccattcaagccggtgtcaatatgaagaacattataaacggcgacatgaaaagctttcaacaagacccgtccagcctggcgctgccgattataagcgagaaagacgcagaagggacggagctttctgacggagaagccgtgtttaccggatataatgatatgatgaaaagatttctcgacctgaaaacgtcgggttccattgatataaacggcaaaacggataaaataccgctggcgtataagggcttgaagaacgacttcctcctgtcatatacatttacaagcggagggctgccgaccgttatcgtcacgcagcaggtattcgaccggatcgagaaagatatcgacccgtccatccagggaaaatcaaatcggtttttcggcattacactcaaacgagaagaggacatccaaaaagctgatggtctgtttcaggcgcagcactattcagacggtgcgctttcacaatttgaaacggctgacacgcaaaagaaaaacatggggctgatcatgtttattgtcgggtttttaggattaacctttctgatcacctcaggctgtatcctttattttaaacaaatgggcgagtgtgaggatgagaaggctgattatacgatattgcggaagctcggcttcacaacgggagatctgctgaaaggcatccgccggaagcaggcgtatcatttcggcattccgctcgttctcgggctgttccacagctattttgccgttcagtcaggatggtttttattcggaacggaagtgtggacgccgatgatcatcgtcatggcgctgtatacgctgctgtactccatcttcggcatgctgtcggtgctgtattataaaaaggtcattcaatccgccttgtaaaacaagttgaggagcctccgcataagcggaggctttttttgtatgaatagaagaaagcgatttttaaaagaatagacatacgtcattttttcgcgcgggggagccttatgcagaagtattttcaattgaaatctgaaacaggggcctttcatcttttttccaaggaacacattttcacattgttgatcatcgggttgctgggggcgggcgtgatcgtattccggaaaaagctcaaccagagccgcatgatccgctatgtactattcattctccttgccgtgtcgcagatcagctatcatatatggctgctttgtcatcatgcctggtcgctgaaaacagctctgccgctgcagctgagcgacctttccgtctatttggcgatgctgatggtcatgacaaaaagcaaaaagctattcgccttcctctattttgccggtttgggcagcgccgtacaggcgatggcaacacctgatttaggggcgtattctttcccgcattttcggtacatcgtgtttttcgtctcccacggctgtgtttttcttacctgtctattcatggccgcttcagaaaggtacaggccgtcggcgcgcgggctgtgggtgtcggtgctgatcgtaaatctgtacggggcgtgtgtcttttttattgatcgtgtgctgaatgcaaattatctatatttaatgaaaaaaccgaagaccgcttcgcttctgaatgttttcggaccttggccgtggtatcttctatcaatggaagcggcggtgatattgagcttcttcattctgtatattccgttttggctgctgaggaaaagagcatgaagccgggctgtttttgcgaatccaatcatttgtaattttttcaacattccggcattatttttttcagattctgatgttgaaaaaagacgtccgcggcgatagaatgaatgtgctatgataacgtgatcgatacggagccgcggcttgcggtttccgttttttcatggggttttttatagagagagggggatcggtatgccgcgcgctttgaagatattaatcatcggaatgtttatcaatgtgacgggcgcatcttttttgtggccgctgaatacgatctatattcataatcatttagggaaatcgctgactgttgcggggattgttctgatgctgaattccggggccagtgtggcggggaatttatgcggcggatttttgtttgataaaatcggcggattcaaatccattatgctgggcattatgatcacattggcaagtcttctcggactcgttctgtttcaccaatggcccgtttatatttggctgctcatcattgtcggcttcggttccggtatcgtgtttccggccagttacgccatggcgggagcggtatggaaagaaggcgggcggagagcttttaatgcgatttatgtagctcagaacgcaggtgtcgccgtgggctcggcactcggcgggatggttgcggcgtactcgtttacgtacgtgtttttagccaatgctttgctgtatgtgctgtttttccttatcgtatttttcgggtttcgaaatatcaaaaccggaaatgcgagccaggtttctgttctggactacgagcctgtcagcagcagaacgaaatttacggcgcttctcatattgagcggcgggtatgttctcgggtggattgcctattcgcagtggtccacaaccgttgcgtcacatactcaaagcatcggtatgccgctttcattatacagtgtgctctggaccgtaaacggaatattaattgtcgccggacagcctctcataggagctgttctgaaaaaatggtcaggcgcgttaaaaacgcagatggtcatcggcttttgtatttttatcgtttcgttcggcgtgcttcttagcgccaagcaatttccgatgtacctcaccgcaatggtgattttaaccgtcggagaaatgcttgtctggcctgccgttcctaccattgccaatcagcttgcgcctaaggggaaagaagggttttaccaaggattcgtcaacagtgcggcgacgggcggcagaatgatcgggccgctccttggcggcgtgctggttgatcagtacggcatgagcgtgctgctgttgatcctgatggtgcttcttgttgtcagcatcgcagcgacggtgctgtacgacaaacgcctgaaaaccgttaataaacaaaacatccaagtgcgatgacgacataaaaaatcccgccgaaacagcgggatttttttgtttatacgaccggaagcacgttgacggcgtccttaacgtttaaatacgtctttaatgaagaaaagctggcatcaagctgattcattctcatggcgagggaaggcttgatcccggtgataatcagttctgtgccgattaatttaagcaggtggtgcaatttgaaaatctggtctgccgtctgttcgtttacctcggccaaacctgataagtctataattaagtaatcatctttagatgcggttaatatgtccgtcaaagttgtcacaattgaatcaaatcgttcttccgttaagtttcccactaacggcaaggcggagatgccgtttcggatcggaacaatcggtgttgacagcgtcgtgatttctgtgagggaatcctccaggagcttttcgtattctttctgctctgtaatgtctttttgaaaaccgacaaaatagagcttgtcttcaacatacagaggatcaatgttgagttcattccaaaacggggtgccgtcttttttgacatttttcagccgcaccgtgatcttttctttctggtttaagctctttcttattttcgcgacttgttgacggtcggtttctttgctttgcagaaatctgcagttcttacctaatatctcttcggaagcgtagcctgtcatatccataaatccctgatttgtatatatgatgggattgtcctcaagagaggggtctgtaatcaccacgccgatgcgtgcgtgatcaagcgcctttttgataagctccagctgctccagttttccggatacatttgagtcagccatgtaaaacccccttttggccgtaaagctgcgcgcttttttcagccgttgtttctcccctttttaaatgaatctacagtaaccgtagcataacatatgttctgattcaagcagccgaagtttgcaatttgtcattcgggcttgtcctcatatacactgaatatataaggggaaggcacatcatcgctaagtaagtgactaggtcattgtcactgggtgaaaaatgaatctaatgcatcaagcttaccgatcatgtgttcacatataatggaagaaacaagctttttactttcctgctcaatcgccggtatgtagatatcgaaaatcatcgtattcgtaagggggctggatggcctgaagtcgctttactaaataagggctttaggaaggtgatgaagatgctgcatcaggtaataattgcttgtgtaattggaggcatcatgggggttctcggtcatgtgaaaaagagaggcaggctggagaaacccagaatgacaaagcggtttatctatctcggttttttggaagatggttttatcggaatggctgcttccatcttacttgtcttatccgctgaccccgattcaggaattcaactcgtcatcttatccataatcgcaggctacggcggagaagctgttctcaggagctttgattttgtcagagaacaaaacagtgattcggccgaagcaaaaccacaccagcaaaaaaatcctccatcaaaataatatccccgctcacgacccgttccgggtacattcccattgtatacaaacctgcttgcacttatgaacagaattctataaaatacaggtaagattacggtagcgataagaacagtgaagaggagcagtaagaagcagatttcgcactcagagaattgacggccggtgcaagtcaatcaagtctgtttccgaactcgcctcagagttgcagcggcaaaaccgctgacgcataactgcgttaaaagtatcaagtgagtgcggcttaaaaccgcgctaacgagggtggtaccgcgggaaacaaaaatctctcgtcccttttagggatgagggagttttttttagttttagaataatctgaatataatcttcctcatcccgtcaatacttggactacatacgccgtattcaatcagaaggaggtttttacgttgagttttcagcacgaaaaaatagaaaagaaatggcagaattactggttggatcataaaacgttcgccgtcagtgaagagaatgacaagccgaagttttacgcgcttgacatgtttccgtatccttcaggagccggccttcatgtcggacatccggaaggctatacggcaaccgatatcctttctcgcatgagacgcatgcaagggtacaatgtgcttcatccgatgggatgggacgcgttcgggcttcctgccgagcaatacgcgcttgacacgggaaatgatccggctgagttcacaaaacaaaatatagataatttccgccgccagatccaatcactcggattttcttatgattgggatcgtgaaatcaatacgactgatccggactattacaagtggacgcagtggatcttcaccaagctgtacgaaaaagggctcgcatacgtagacgaagtgccggtcaactggtgcccggcgctcggaacggtgcttgcgaacgaagaagtcattgacggcaaaagcgagcggggcggccatccggttgaacgccgcccgatgagacaatggatgctgaaaatcaccgcttatgcggacaggcttcttgaagatttagaagaacttgactggccggaaagcattaaagacatgcaacgcaactggatcggacgctcagaaggcgcaaacgtgcatttcgcgatcgacggcactgatgacacgtttacggtgtttacgacaagaccggacacgctgttcggcgcggcttatgccgtactggctcctgagcatgagcttgtggaggccatcacgacgcctgaacaaaaagaagcggtagacgcttatgttaaagaagttcaggcgaaaagtgacctggaacggacggatcttgcgaaaacaaaaacgggcgtcttcacaggtgcatatgccgtaaaccctgcaaacggggaaaagctgccgatctggatagcggattatgtcctcgcctcttacggaacgggcgctgtaatggccgtgccggcgcatgacgaacgtgattttgaattcgccaaagtgttcagcctgcctgtcaaagaagtcgtaaaaggcggaaacacggaagaagaagcgtacacgggagacggagaacatgtcaattccggctttctgaacggactgaataaagcggaagcgattgaaaaaatgatcgcctggcttgaagaaacgaaaaacggtgagaagaaagtgacataccgtctgcgtgactggctgttcagccgccagcgctattggggcgagccgattccggtcattcattgggaagacggtacgtcaacagccgttccggcggaagagctgccgctgattctgccgaaaaccgatgagatcaaaccgagcggaacaggtgaatcaccgcttgccaacattaaagagtgggtggaagtcactgatcctgaaacgggtagaaaaggcagaagagaaacgaacacgatgccgcaatgggcgggaagctgctggtatttcctccgctttatcgacccgaaaaatccggatcagctcgcttcacctgagaaactggataaatggctgcccgttgatatttacatcggaggggcggagcatgccgtgcttcaccttctgtacgctcgtttctggcataaattcctctatgatatcggtgtcgtgccgacgaaagaaccgttccaaaagctgtataaccaagggatgattctcggggaaaacaatgaaaaaatgagtaaatcccgcggaaacgtcgtcaatccggatgaaattgtggcgtctcacggagcagatacgcttcgcctgtacgaaatgtttatggggccgcttgacgcatctatcgcctggtctgaatcaggccttgacggagcacgccgcttccttgaccgcgtatggcgtttgtttatcgaggaaaacggcgagctgacgggcaaagtgacagaaggcgcgggcgaaactcttgagcgcgtctatcatgaaacggtcatgaaagtgacagaaaacttcgaagcccttcgttttaacacgggcatttctcagctgatggtgttcattaatgaagcttacaaagcgaatgaactgccgagagaatatatcgaaggttttgtgaagctgctttctcctgttgcgccgcatttggcggaagaactgtgggaaaaactcggccacgaaggttcgattgcatacgaggcttggcctgcttatgacgaatcaaaactggtggacgatgaagtggaaatcgtcgtccagctgaacggaaaagtaaaagcgaaattaatggttccggctgatgctgataaagcagcgttagaacagctcgcacaagctgacgaaaaagtaaaagagcagcttgaaggaaaaacgatccgaaaaattattgccgtaccgggcaagcttgtcaatatcgtggcaaactgaccggacgaagcccctctcctacagagaggggcttttttatcaggcctctatcatagaaattgcaccgcgggctttggtatacttaacaccataaagatgaatgggagtgtcacacattgaaaataaatgaaatcagcacagccgcactggaagaaaaattaaaagcgggagaagagctgtatctgattgatgtcagagaagacgaagaagttgccgaaggaatgattccggaggccgttcatatccgcatgggggacatccctgagaagatggatgcgttagacaaggacaaggaatatgtatttatctgccgttccggaaaaagaagcatgaacgtttgtatgtatttacatgagcagggcttccgtacagttaatgttgaaggcggcatgctggagtgggaaggcgaaacaaagccgaagaaataacgctttgaagtgaaagaagaaaagggacgtgcgtctttttcttctttttttataaaaaaaacgggaggcgaatcaggtgaaaccgatgatccgcgcgatgaaaacaaacgatatcaaacaggtccggcaagtcgcagaacgcagctggcatcatacgtatgaagggattattcccagacacattcaggatcagtttctcgaatccgcctatcaggatgagatgatggaacgccggctcttgcattctttgttctttgtggcggaagaagaggggcgagtgctcggttttgcaaatgccaccccggttcaaaaagacggaaatgcggagctgaccgccatctatattgatccggattgccagggaagcgggataggcacggcacttcttaaagaatgcatcaggcagtccggcggggtaaaaaagctttatgtccatgcagaaaaagagaaccgcatcgccttgtccttttatcaagcgaaagggtttcaaagggtatgtgaatttgaagaagattttaaaggacacaccttacagacggtcaaactggtgctgaacatataaaaacgtccggcccgcccgggaccggatcgcgaatgatcagtgataagccggaagccggtctttgtgcgcttcaaataagtcatcgcacaaagagatgatgtcattcatggaaagctcggcgctcgtatgcggatcaagcatggccgcttgatatacggcttccttttttaatgtaacggccgcttcgatggttaaaagctgtgtgttgatgtttgttctgttgagcgccgcgagctgctccggaagttcgccggaatagcacggcataatttggtttttaacggcggcgcacggcacttcaacgaccgctttcgccggcagattcggtatcagcccggtattcagcacattgccgccgaatgtgaacggacggcccgtctccatcgcttctataattctcgaaccgtattctttcgagcgttcatgcgtcaggttttggttgttgatgatcccgtctctcatcgtttcccagtttttgatttgttccgcgcatctcctcggatattcatcaagcggaatttggagttcatctatcagctccggataccggctttttataaaatacgggtgatattcggcattatgctcagatgattccgtcacgtagcagccgaatttatccatcagctcaaaccgcaccatgtccttatgtttcgtcttttgtttttcgcgtgcccgtcttttaatttccggatataaatcaattccgtcttttttaatctccaaaagccaagccatatggttgatgccggcaatgcgttcttccgtaccttcgtgatccatgccgagtgagtcgaacagatctttggtacagacctggacgctgtggcacaggccgaccgttttgacatttgtatgtctgagcatcgctccggtcagagaggccatcggatttgtatagtttaacagccacgcatccgggcagacctcttccatgtcttttgcgatgtcaaataaaacggggatggtgcgaagggaacggaaaatgccgcctattccgacggtatcggcaatcgtctggcggagaccgtaccgcttcgggatgtcaaagtcaatgaccgtcgcgggtttatagcctccgacctgaatggcgtttatcacatagccggcgtgtgtaagcgcttgttttcggtcatcgtaggagatgatggatatactcggattgtagcggtctctcatgttttccagcatgagctgagattctttcagccgtacagcgtcaatatcataaagcgcgaattcaaatccgtttaatgcttcagtcagtaaacagtcccccagtacattttttgcgaaaatcgtgctccccgctccgataaacgtaattttcttcaacagaaattcctcccttttcttctcagcctttgaccgccccggaggacagccctgagataaaatatttttgaagtgccaaaaacaatacgaccatcggcagcatcgccataattgcggctgcggcgactaagtgaagattgttcgcgttttcgccgaagaaccccgccatggccacggtcaatgtctgcaccttttgatcttgtaaaaagaaaatcgcaaattggtaatcgttccagataaacacgcaggaaataatgcagaccgttgcggtaatcggtttcaacaaaggaaacacgattgtataaaaagtcctgatcaatcccgcgccgtccatcctggcggcttcctcaagttctttcggaatggaagagcggataaaccctgaatataagaaaacggtcagcggcatatatgcagccgtattaatgagaatggctgcggcatgcgtattgaccagccccgcatcagcgaccatcttgtataaaggaaccatggaagtcaaaggcgggataatcatgatggaaatcaaaaggccgaagacgattttgttcagctttgtatttcttctagcgagcgggtatgcggcaagcgaacccatgaaaattagcaaggcggcggaaacggctgtaataatgatcgtgttcagaaaggattgcccgagagaggcacgctcccatgcttcacgaaaattctgaaatgaaaaggcggatggcagcgaccattttgaactgtagtctccttttgcttttaatgacgtggtcagcaaaatataaaaggggacaaaatgaacgcacgagataacggcagccaacagcgtaaaaatccgcattcgggctgttttcatgacatttccgtctcctttcgcttgaaatacacgagagccgaaaagctgatgacaagaataataacggacataaacacgccttgggcggcggcatatcccgcatcctgccgtttaaaatataaatcatacataaacgtcgacatcgattgagaggaattgcccggcccgcctgcggtcagagcgaaaatgacatcaaacagcttcagcccgccgatgatattgatgaccatgttgatggtgacagccggcatcaataatggcagggtgatggtgaaaaacggctgaagacctcccgcgccatccatttttgcagcttcataataatctttcggaatgctttgcagccccgccaaatatacaatcatcgcaatgcctgcgtattgatacgtgttaatcatgacgataatccacgggtttgccgcagggcttgccaaggcgttgacaggaccgattcccagtgcgcccagtacatcattcagcgcacccccgtcatatgagaaaataaaataccaaatgtatcccataatcagcggactgataatgacgggcaggtagacgatcgttcttgtgagcgccttcatttttaagctctgattcaaaagcagcgcatataaaagtccgagcatattctgaaaaaaagtgcttccgatgccgtaaagcaaagtgtttttcacaataagccacgtgtccggatctgtaaaaagccttttatattgagtgacccccacccattgatacgtctgtgagaagccgttccagtttgtgaatgtgataaaagcgcctttgacaaacggaaaaatcatgaaaataaaaaccgtggcaagagcgggaacgtacatccaccacagtgacgcgggttttaccggcttttgatgctgaaatccttgggtttctcttgcaagatcactcattctttgtcagctccttgtgaatcagattgaagacggagccgcttatattccctgccgagtttcgccgaaacttccgcgggggttaagatatcggccgtcagctcctgcccggctgtccccatcacatcccacattccgttcggcaaataaaggcggtcaaaataaggctgcaccttaatatgctgatagcgcttatagtcatttgcgtagaaaatgtccgtttgcacattcactaatccggccggaagcgaggtcgcttcggcaattgatttcgcatgctcgggacgggccataaatgcgatgaactgtttcgcttcttcaagccgcggggaatccttgaatgccgccagcgtgtaacgttcgcctccgatccaaaccggcgcgtctcccttgtggacggccggggtcggtatgatgccgacttttaccttcggattgatttgagcgacgtcttggccgagggtgccgccctgcagcgtaaaggcgattttgttttgcgccatcagttcaatgagctgggaccgttttgccgtcacggcatctatattgagcaggctttccttttgcatctctttcagtttgtcagataaataggtgaagtgtgtccagcggaaggttccgtttaacagctgttttttgtaacggtgtgcgggatctgtgatgagaagcggtgcggcgaattgatcgtaatattgggcaaatgagcttttctcatagccggcaaaccagaagggggtgactgttccgccgcttttttctttaatctgtctcagtgccttcataaaatcatccattgtttccggcggtttgattctgtatttttccaacattgtgcggttgtaggccagtccgtcctttgcctgattcagagggaaggcgtatattctgcctttggcgtctttgagcatgctgtttaaattcggatcgagccgcttcgtccaagacatgccgctgaggtcggcggtatattctccgtagcggattttagcccagccgtgtgtgtcgaaaagatcgggcatgtcaccggctgccattctgaccctcatcatattttcgtagtcattgcctgggaaatgaacgtttacttgaatgtccggatgttctttttggaatgaatcagccaactttctgaatacggcgcgttcgctgtctgaggatattgtggaatagactgtcaatgttttctgcttttctccggcgccgctctgttctgccgagcagccgggtagtatcatgcaagtaaaagaaagaaacaaagccagtaagcgtttcatcttttcctcctttaaatatgatataaacgctgcgggacatgtcacctcctttcttgtgagccgcagctttgtctgacaatcaatgaagtggggagcgtcacggccagcgggacggttctgccgtttaaacggtcgagaagcaatttgacacccgtccggcccatctcttccgtgtatacttttaccgttgataacggcgtgctggcgtattctgcctcatcaattccgttgaagctgacaattgccgtatcgcgcgggacttgaaggccggcttcctgcaaggcttttaaagcgccgacagccatcgaatcacttgcgataaaaaaggcatcggggagacttccgcctttgatggcttcattcatcagccggaacccttcgtgcatgctgtattcgccgatcagtacatgctccggcccggctccggccatttgtaagaaagcggtcagacgcttatcctcaatcgttttattgctgtttacaccgtctatgacggtatgctcccgttcccggccgccgatataaccgagccgctggtaaccgagcgacagaagatgttcgatcgccttttgcgctgcggcataaaaatccacgctgacagaatcgtagcgggcgggatcgggggtgccgttaacaaataccgcgtgcctgaaagcggcgctgatattcgtaagcgcctcgtcttgcaggctgccgattacgatcacgccgtccagatcgtgaaacatatgctcttgaaaagacccgagatggatagaagatgtgataaaaactttttgccgaaagcattcttcctcaatgccttttcggatcgctgaaaaataaggatcctgccgttcttcttccggtgacaggcagctgacaacgccgatcaggggggctgaatcgctgcggctgcggttcttccgtttttttgccgacggctgatagcccagctcatcggcgatcctcagaactttttctcttgtttcatcagtcacggccaaagagtcatccttattcaaaattctcgatactgtcgcgctggatacagatgcctgtaaggcaatatctttgagacggaccatttcgtatctcctttttactaaatatttactaaacagaaatgacctggttattgttaaaatgatattatcatatattagtaagcgttttcaataactatttttggttacttttagtaaaaatcagtaaaaaagaaaatctgtttttctctatcatatttcaattgaaccggaataaattgatagagaaaggagagggtgatgtgctgaagatagctgtttttgatgaggagcatgaaaaggatctgcagactgaagtcaatacatttttaaaggggatttctgatgaacagctcgttgatattaaatatacggtagcggcggcctgtgatcctgaaggtgagcagctttattgtttttccgctctcattttataccgaaaataaaaaagcccggatgaaataccgggcttttttatgcattatgcttttttgacgcggggacttctcggtttttggtatttctccgcttgtttgattccttttctttcgctcgctaatgacttgtacagagacacgatcatcagaaggatcacgactgaaaacggaaccgcggcgagaatggccgtgttttgcagtgcggccagaccgccggaatataataatacagctgccacggcggactggatgacgccccagatgattttcacccggtttgacgggtccaaagagccgtaagacgtttgcattccaagcacaaatgtcgctgaatccgctgatgtaataaagaatacagcaatcagaataagcgttaatacggatgtcaccattgtcagcggatagtggctgagtgcgccgaacagcatcgtatccgttgacattcccgcgacattgaatacgcctttctgctgaagatccatcgcggatacaccgaaaatcgcaaaccataagaaagccaatatacaaggtgtcaccaacaccccgattaaaaattcccggatcgtccggccccttgatacacgggcgataaaaatgccgacaaacggcgaccaggatatccaccaggcccaatagaaaatggtccagctgttaatccattcgcgtttttggggatcattcggagacaagcgaaagctcatctgcacgatattttggatgtattggccgatagaatcggtaaatgagttcataatcagcactgtcgggcctgcaatgagcataaagatcattaaaatacccgcgagcgccatgttggtattgcttaagtatttaatccctttgccgattccgctccacgcagaaatcaaaaataacacggtcacgacagcgatcaggatcagctgaatggaaaatgttttcggaatgccgaataaataatgcagaccgccgttgatctgagtcgctccgagccctaagcttgtcgccacaccgacaacggtcgcaaacaccgcgatacagtcaattgctttgccgatcgggccgtttactttatcgcccaaaagcggtgtcagagtgctgctgatcaaaccgggcgcgtcttttctgaattgaaaataagcgatacataaagcgacgaccgcatagatggcccaagcgtgcagtccccagtggaaaaacgtgtaccggagcgcatcacgaaatgcttggggtgtttctgtttcacctgagggagagctgatggcgtaatggctgatcggttccgcagccccgtaaaataccaaaccgattcccatgcccgcgctgaaaagcatggcaaaccatgataataagccgaattccggtttttccccgggttttccgagttttattgtgccgatcggactcacaatgagaaagagacagaaaccgacaaatatagaaacgaccagcagataataccagccgaaagaatccgtaataaatttttgtgccgtatcagtgacttgctgcaggctgtcaggagaaatggccccccataaaaccgcagctgctgtgatgacaatcacaatccaaaaaacactggagatgttcttcttcaaacgttctcaccctctgactatttttttcaatacgccattttttagtatggtcgcacgattgcagatcattcctttcttcctgttccctcaatcaggtgaaacaaaacgcagaaaactgtatcatgtttttggtcaattatcaacggggacgctcaggtaaatgcgctttaaaccatttacagcgagcgtgagaaacgtcctgcattcaaaccggcgagacgccccgtgacaaaggctgaagtgatattgtagcccccggtataaccgtgaatgtcgagtatttctccgcaaaaatataagccttccatttttttagacgccatttgtttcggctcaatctcttttacggaaacacctccgcctgtgacaaacgctttgtccaaagaaagcgttccgtcagcggcaaccgtaaattgtttgcagtctttgacaaaagccctgaattgatccttcggcagttccgtaaagcttgtctgcggatcaagaccgttccgttccagaagaaaaagcagataccgttcctgcatccacggcttcagtgcgtttttgagcgcttttttcggtgcgtctttcagttccttgtgcatcttttgaaataactcttcctcgttgatgccgggaaacagatcgatgcgtaatttgacatcgggctgctttttcagttctttgacgacaaactggctgcagcggagaatggcggggcctgacaagccgaaatgggtaaacagcatgtccatcacgtgtgtgacaataggtttgccttttttattcaggacgctgacggccgcgtttctaagggacagcccctgaagtgttttttgtttaataaacggttctgacgacgtaaccggcacttccgtcggaaagagttcggtcacggtatgaccggccgcttccgcccatgcatagccgtctccggtgctgccggtatgcgggactgattttccgccgaccgcgataatgacggcgtctgcgttaatgtgttcgtcattgtttgtcgtaatgcccgctgtcctgccgttctcgtaccgcacctctttgattttttcatttgtgcggatggtgacattcagttgttttaatcggttcaaaagcgcatcgacaacgctttgggctttgtccgtcaccgggaacatgcgcccgtggtcttcttctttcagctgaatgccgagtttttcaaaaaaggcgatgatatcttcattattaaattcggaaaacgcgctgtataaaaagcggccgttgccggggatgtgtttaatgatttcttcaacggggaggcggttggtcacgttgcagcgcccgccgccggaaatcgccagcttccgtcccagcttgtttcctttatcgattaataatacgtccgccccttcttcgcctgccgcaatcgcagccattaaaccggacgggccgccgccgatcacaattacgtcataatgtttcatatttcatcaacaactttctttttcacgtataataggcggaaatgtccgcttcctgctattatagcgaaagaaggggattccttaaacgtattttgtttttaagagctttcccaaaaagtttcccgctgtaattattaccgtctaattgcccagttgtgttaaaatagaaaagttgaatcttcgtagaaaatggtgatgaggaaacatgtcaagcaaattgttaaggggcacgttcgtgctgacgctcggcacctatatatcgcggattttagggatgatttatctgatcccgttcggagcgatggtcggagcgacgggcggagctttgtttcaatacggatataatcaatatacactgtttttaaacattgccacgatgggatttcccgccgcggtttcaaaatttgtctcgaaatataactccaaaggagactatgagacgagcaggcggatgctgagagcgggaatgtcggttatgctcgtaaccgggatgatcgctttttcaattctttatatttcggcgccgttttttgcggaaacatctctcggcggcacgagtaacaacggacttacgattgaccacgtcgtttatgtcatccggatggtcagtctggcacttttggtcgtgccgattatgagccttgtgcgcggttttttccaaggtcatcagatgatggggcccacagccgtttcacaggttgtggagcagcttgcccggatcatctttttattgggcgcaacgtatttgattttaagagtgatcaacggcggccttgtcatcgcagtcggatacgcgactttcgcggcgctgatcggatcattcggagggcttgtcgtcctttatatttactggaataagcggaagggcgatcttctggcgatgaagccgaatctcgtcccgtctgcgaacttaagttataaaaaaatgttcattgagcttttcagttatgccgctccttacgtatttgtcggactggcgattcctttgtattcatatatcgatacgaatacgtttaataaagcgatgattgcggcgggccataaggatatcagccaggacatgcttgcgattgtcaccctttatgtgccgaagcttgtgatgatcccggtttctctggcgaccgctttcggtctgacgctgattccgacgattactgaatcgtttacgagcaggaattataagcttttgaatcagcagattaaccagacgatgcaaattattctgtttttggttattcccgccgttgtcgggatgtccgtgttatcgggtccggcctatacgttcttctacggctctgaaagtcttcgcccggatatcggacaggatatattgttctggtacgcgcctgtcgcgattctgttttctctgtttaccgtaaacgccgcgatcctgcaagggattaataagcagaaatttgctgtcgtgagccttttcatcggcgtcattataaaagtggtgctgaacgtgccgctgatcaagctgtttcagggagacggggccatcttggcaacggcgctcggttatatcgcttctcttctgtacggttttatcatgattaagcgccatgcgggctattcgtatacggtacttataaaacgggtcattttaatcgcagtcctgtccgtcgtgatgggagtcgcggtcaagctgactcaatggctgctcagtttctttgtaacataccaaagcggccaggtgcatgcggcgattgtcgtctttgtctgcgccgctgtcggcggtgcggtgtacatgtttgccgcgtaccgaatcggatttttacagaaaatgtttggaaaccgtctgccccgcgttttgaggagaggcaggcattccgcccattgagaaataatgaatagtccgcttatcgcgggcttttctttttaaaggagaggatcaggatgagacttgataagctgcttgccaacagcggattcggctcaagaaaagatgtgaaaaaaatcgtcaaggccggggctgtcatgattgacggagagccggcgaaagatgtgaaaacccatgtcgatccggaaaaacaggacatcacggtatacggagagccggcagactatcgtgaatttatttatgtcatgatgaataagccgcaaggagtgctgtccgctacagaagacagccgccagcaaacggtggttgatctgctgacgcctgaagaacagcgatttgaaccgtttccggcgggacgtcttgataaggatacggaaggctttttgcttctcaccaatgacgggcagctcgctcatcgcctgctttctccgaaaaagcatgtgcctaaaacatatgaggtccggttaacttcacctctggcatcggaagacatcgttcatctggaaagaggcgtcgtcattgaaggaggctataagacgaagccggcagccgttgaaatcattacagaaaacccggatgaaacggtgattcacttgaccattacagaaggcaaatatcatcaggtgaagctgatggcaaaggctgtcggaaatgaagtggcttatttgaagcggctttcgatgggggctgtttctcttgacccggatcttaaaccgggagaattccgcgagctgactgaagaggagctcgaaacgctgagaggcgctgaagtgtaatcgatatcagaaaagcccaaaacagatttgttttgggctttttatatagaggaacaaaaaacaaggcaaagacgctgctttgccttgcagcatgtcaggccgaaaagggccttatgtaattgttcgcttaagatgtaattttcactttttttcgtgttgtctcccacttgcctcggctaggactatgaacaagatcattgtatgctaacacatttaagtctcgctgaatggttctaggtgtaatgccgaattcatcaaccagttcctgtgttgtcacaaggcctttttcctggatgaacatgtaaactgatttaatccgagtcagcatacgatttgttgaaggtttcaaaaaaccactccctatcataagatcggatggacttgatataccacaactttcgactctaaaacttcgtacgaataagcaacaaaggatgacattctgttttttttctcttttaactgcctccattatacacgatatggacgacatgaatctaggaataagcgcagataattttttccaaatgggtgcagccttggtgcattactatgtccggaccgcttttaatattatggaaactgaaacttttttatacatgtccgtatgaaagcgggggagtgagaagtttgggagaattattgaatgcaaacattgtctgcgccggttatgctgacaggccgaaggtgatttccgatgtatctctgtcagtcaacgctggtgaaattgccggtttaatcggagcgaacggcgcggggaaaagtacagtgataaaggcggttctcgggctgtcccgggatattgaaggcggtattgagtggaatgattcatcttatgcttacataccggagcggccgagtttttacgatgaactgacgctttgggagcacctcgagctgaccgggtcattgcggggtatagaaggggaagagtgccgtgagcgggcagggcggctgcttgaagagttttcgctgacgtctgtaaaacatgatttgccttccggtttttcaaaagggatgcagcaaaagatgatgcttatacaggcatttttggcgaagccggatatttacatcattgatgagccttttatcggacttgatccgatctcaacgaagctgtttaccgacatgctgattgctgagaaagaaaggggcgcgggaattttgatgtgcacgcatgttctggatacggcggaaaaaatctgcgaccggttttatttgctggatcagggcgctctgcttcttcaaggcacgttagaggagcttcaggaaaaaacggggagccgttcactgctggattgcttttattcagcggttcggagcagtcagcgatgaccgggcgggctttgttttttcaaaggctgtttcattattggcggtatcaatggaaggtgtttcagacggtcattgattggacggtcgcgctgtacatcgttcttcccgctgccgcatttgccgtttatcaatatgctgaatggctgaacggcagggggcttcttaatggagcggcaggagtattaggatggggctggctgtatgtattcagtgccttgctgttgtgcacgggttttattcatacctttttgctggaagcggatcacgtgtttttggtgcatgcaaaacatctgatgcaaaagctgaaacggtacgcgcttttgtattcgatgttcctttcccttatcaaatggggtgcgcttgccgtattgttatttcccttatggcgccagtacggtgactgtaccttaccggcatattcaggtatgttttgctgtctgttcggcttccataccgcgatattagcggtgcaccggcacagaaaaaacagcaggcggacattcgggaatcaggcggcgggctggctgaaagtgatggttctgacggcgggtgcgttttttatgatcacctttgccgccgaatggtattggctttggccggcgggatgtatattgttcatctgttccgcttttttgacttggaaagggacggagacattatcagcctttgaggaagaagtgcttgaggagaacaggcggaagctttcactcgccgcctcagttttgatgctcagccatgatgtgcagctcccgaatggtaaaaataaagggcggagcaagccgtttttatatcccggctcaaagcacatctttacaaaacggtcggcgtatacggcgtggaaagaattgttttttaaagtgctgatccgaaacggcgggtatctccggcagctttaccttttaaccgcggcttttacggctcttattctcgttcttccgctcttagtgaagccggcagtccttattttatttgcgatcgtcagccgctatgccgcgtcacttttatttgaccggatcacggataaaccggttttaagcggtatcaagagagacagtgatgactatttccgggcgcgaaacagtgcattaaccgtcattcaaatcatctgttccgcctggtgtctcattgccgcgattctttccgttctttatatgtaaaaatccctttccgaaaaggaaagggatttttcttaatgtccgttcaaaataaaaagctgaataaaaaacagcacggcgaagatgaggactagaggatggatttcgcgccattttttcttagctgctttaacaagcggatatgaaatgaagccgagtgcgattccggttgaaatactggacgttaaaggcatcgccaaaatgacgagaaaggccgggaacgcttcgtcaagctcattccagcggatattcgacacagcacccatcatcaggctgccgacaataatcagagccggtgacgtaatcgcggacacttccgataagacgctgacaagcgggctgaaaaacatggaaacggcaaacataacggcaatcgtcagcgccgtcagacctgttcttccgccggcggccacacctgctgaagattcaacgaacgcggtcgtcgggctggtgccgaagatgcttcccaccgtcgtagccgttgaatcagccaacagcgctcttctggcattcggcagctgattgtttttgatcaatcccgcttgttcagcgacaccgatcatggtgccggtcgtgtcaaaaatcgtaacgagaagaaaagaaaacacaacggcgtacagaccgtgatgcacgacatccccgagggcaccgaacggatttgtgattaaaagcccctccggcaggcgcggaaatgaaatgaaccctttcgcaaaatggatctgtccggtcaaaaaggcaatgacggcggtcagcgccattccgatgaacagagcgccgtttacattcagcaccatcagcacgatactgatgataagtccgataagcgttaaaatgacggcgggcgaatgaagatcgccgagtgcgaccagattggatttatcagccgtgatgattccggattggcgtaagccgataaaagcgataaataagccgatgccggtcgtaattccgtattttaaattgtccggaatcgcttctataagttgttttcttaaaggcgttaacgataaaataataaagatgactcccgcgataaaaacggcgctgaaagccgtctgatacgtaatgccgctgcctgtgccgacaacgtgaaaggcgagatacgcgtttaagcccatgccgggggcaatggcgatcggaaaattcgcagcgagagccatccataaagttccgacaatggaagcgataatcgtcgcggtgaacacctggtcaaacggaattcccgcattggaaaggatcaccggattgacgacaatgatatacaccattgtgaaaaaggtggtcaatcccgcggtaatttctctttttattgtcgtttgatgcttgtcgagatgaaacataagtacctccaatgacgaacattttttcaaaacatcatctatattattcgttttatcgacattttgcaagtctttatcaagaaaggggatttgtgatgaactgggaagttgaagtcatcagaaacaaagaagatctgatccgtgacacgcagaagtttttgcagatcaacagcgtaatggacgaatcaacagccggtcccggccggccgtttggagaaggcgtcaatgccagcctggcgtcactgctggaattcggtaaaaaagaaggcttcaccgtaaagaatcttgacggctatgcgggccatattgaatggggaacgggtgacgaaatcgtcggtgttttgtgccacgtcgatgtcgttccgcccggagacggctggacgagcgatccgttttcagccgatatcagggacggccggatatatgccagaggcgccattgatgataaagggccgacaatggcggcgttttatgcgctgaaaatcgtcaaagacatgcagcttcctttatccaaacgcgtgagaatcatcatcggaacggatgaagaaagtgattggagatgcgtggatcactacttcaaacacgaaaaaatgcctgacatcggctttgctcctgacgcagattttccgatcattaacgcggaaaaaggaattatagatgcgtcactgcgcattgtaaaaaacgcttctgacaaagacgcaaaaaacgtgcttctgtcattccgttcaggactgcgcttgaacatggtgccggatgcggctgaagcggttattgaagggaacggtattgatgccgtgcacgcatatttcagcaaatggcttgagcagtcaaaaacacaaggtgaagcagtttcggaaaatggaaaactgacgcttcgggtatacgggaaatcatgccacgcgatggaaccggataatggtatcaatgccggcttaaagcttgctgaatgccttaacggaacagagctggatggagccggaaagcactttgtcaaaaccgtcagtgactattttttaaatgatacacgaggcaaaaagctgaaaattgattgcagggatgacatcagcggagagcttacattgaatgtcggcacctttacatacagaaagggtgaggatggagaactcggcatcaacatccgttatcccgtcacttcagacagcaaagtcatccgtgatgcttttacgtctgctgaagaattccggcttgaagaatttaaagacagcaaaccgcaccacgtttctgccgatcatccgctcgtaaagacgcttcaaaaggtttacgaaggacagacgggaaagaaagcggatctgatttcaatcggcggaggaacgtatgcgagatccctttcggcgggcgtcgcgttcggtccgctgttccccggccggcctgacagcgcgcatcaaaaggatgagtacattgaaatcgatgaccttctcaggtcaacggctttatatgccgaagccatttatgaacttgccaagtgataataaaaagggacgccgaaagcggcatccctttttatcattcaaatgaccataaatccgtggataaataacgttctcccgtatcggccgtcatacagatgacgatctgttcgggagggaggcgtttggcggtttcaatggcggcgaagcaggcggcgcctgaagacgggccgacgagtatgccttcttcccgggccagacgacgtgttgtcgtatacgcatcttcatcagatattttcatgatttcatcgtaaacgtcctgattcagtatgccgggaataaatccggggcttgtcccgacaagcttatgagcgccgggttttccgccagacaggacgggagatcccgcaggctcggcgacatgaacaatcatatccgggaaaagctctttcagcgtttctccggttccggtaatggtcccgcccgttcccgccgttgccacaaaagcaccgagcggtctgttgagctgctgaacggcctgatagatttcaatggcggtcgtttttcggtgggcatctggatttgcgccgttatcgaattgcatcgggataaaacttcccggaatctgttcggcgagttctttcgcttttttgatgctgccgggcattctttccgcccccggtgttaacacaacctccgcgccgtacgctttcaggaggttgatgcgttctttcgtcatcgtgtcaggcatgacgaggattgccttgtagccgcgcgccgccgcgttcatcgccaggccgatgcctgtgttgccgcttgtcggttcgatgatgacagagccgggttttaaatgcccgctgttttccgcttcaatgatcatattgtaagccgctctgtctttgacactgccgctcgggttaaacgattctaattttaaatagacctgtgctgcatgttctggctgaaggcgattgagctttacgatcggtgtgccgccgatcagctccgccgtgctgtttacgattttcaaggccggctcattcctttctgtataaaacgttcggtacataatatcctatcataatgagcggacagggttctcctctccgcttatccgttttataataacaccataaccaaagagggggagatcctcgtatgaaagcttcattgccgcattattttatcggcattccgattccggctgacattgctgaaccgatttgggaagcagccaaaaaggagccggcgttatcattcaaaaaatgggtgcacccgcatgactatcatattacgctcatttttctcggagccgcggatgaagaacggcttgcgaaattatcgtctctgctcgcagatgctgcgtcggcagcgcagccgtttaccgtacagtttcagcatctggatattttcggcgaccgcagacagccgagagtgcttcaccttgagcccgaacggaatgaactgctctttgatttgcgggaaaaaacaaaacaggctgttttgaaagccggttttcaagtggaaaaacggccgtatcaccctcatatgacgatggcgcggaagtgggcgggagaccggccgttttctgacgatgtgccgtttgaaagcggcagggtgcaaagtgccgtcagcaggttttccctgtttcagacccatcttgaccggtcgcctaaatacgaagaaatcgcacagtttcaattgacataaacaaatattcggagtggagaaatcacatggcacagatcatcaaaattcacgactgcatatccagatatgaacttgatccataccattatatgaaccagtttatccggctgaagaaagaacgctgggaggcgcttcttgaagcgtttgaccggataacggaagaaacggaaacggctgccggcggggaaaccgatcaagcgccggccaggaaaaaattttccttaaaaaagagaaaagaagaaaatacggccgatataaatgaaaagaggcaccaatggtttgatgaaccggagggagaagaggcgctgttcgggaatcttccgtctcaaaagtctgagctcgcgccttttttcaaagatcagctgtatgactttcaattaaaatgggcgagctccacgctttctcaaaagtctgagctttcgcaggcggtcaaaagggacaggatgttaaaaatgctggctcaaaaactgcccgattcctattttgtgatgtatcatccggttctgcaaattcagcaggcgtccgtcgaactgagcattatcatcatctcgccgctggagattttctgcgccgcttttatggaagcggaagaggacagtgtatatatcggatcaaaacaccgtttttgggaagaaagaggctccggcagcacgcgccaagtattgaatccgtctctcagcctgcaccggacgggctcggtcgtttcgcaaatcgtaaaagaaaagcaggccgacattcccgtgcggaagcttttgctcagcagaacgtcttatattgattacccggagccgccgtacgggctggaaatagctgataaacggactgcggcagggtggctggaaaagcagcagaaaaatacggcgccgatcaagcaccaccagctgaaggcggcgaaggctcttttgtcttacggcttgagcgattcaagccggagacaggaatggcttgattaaagcggacgtttgccggctgtctcttcatctatgaagcaggtgaaaacaaacgatgagtcaatggttttttattattaatccggtctcaggaggcgggcggggccggcgtgtctggaaatcagttcaaaaagagctgaccaggcgcggggtcagccaccgctcttttttgaccgggcatcccggacatgcggaggtgctggcaagacagatttcaatgatgcaggatcataagcttaagcggctgttcgtcatcggcggtgacgggacgatgcatgaagtcattaacggactgaaaggaacggatcagattgagctgacctttgtgcccgccggttcgtacaatgacttttccaaagggctcggtattaagaagtcggcgctcctccaagaaatcaaaagtctgcaccgcccgctcacacggaaattttttgcgggaaacatcaacttttttcatgacaaagcgcaatcactctattttattaaccacctgtctgtcggcttcgatgcctcagttttgaaggcagccgcgaattttccgttttcgcgcgttcttcggtttttgcgtctcggctttgtgatttacccgctcgcgcatttacatacggcctcggggtttcagccgttcagatttgtttgcacggcagacggccagagacgtgaattccgcaatgtctggtttgttattgcggctaatcacccttattacggaggcggcatgaaagcggcgccttcagcaaatccccgtcaaaactattttgatattgtcattgcagaaaacctgtcctttttttcgctgtatcgttttttatgggcgatgagcttcggccggcatatcaaaatggacggagtgacgatgataaaggggaaggaattcgtttttgaaacagatgggaaaattccgtttcacgctgacggcgagctgatcggaacgacgccgtttcggcttatgccgggcggtgcgccattgaaaataaaaacataataaacaaatgaaacccgtcaattgtttcacggcaacagagcggttcgcggcataaatcttcagaattcacaggtgttcttgctagttttgcttgacgaagtttgtgctgtagcgctaaaatttataggacggctattgattagcatatgagactctcaatagctgtcttttttattctcatgaaattgtttatgacaggccgctccgccaatagagaaaggctggaggcctattctaaaatattttaagaaatgatgggttgaacattgatatgaactggttgggacaattactaggtagcgattgggagatcttccccgccggaggagctacaggagatgcatattatgcgaaacataacggccaacagctttttttaaaacgtaatagctcgccctttttagccgtgttatccgccgaaggcattgttccgaagctggtttggacaaaacggatggaaaacggagacgtcattacggctcagcattggatggcgggcagggagctgaaggcaaaggatatgagcggacgcccggtggctgagctgctccgcaaaatccacacatcaaaagctttgctcgacatgctgaaaagattgggaaaagaaccgcttgatccgggcgcccttttgtcgcagctgaagcaggccgtctttgccgtgcggcaattttcgccgcttattcaggaaggccttgcttatttggaagctcatgtggatcaggtgcaattcggtgaaaaagtcgtttgccattgtgatgtgaatcataataactggcttctgtctgaagacaaccagctgtatttaatagattgggacggcgccatgatagccgatccggccatggatctcggccctttattgtatcattacgtcgaagagccagcgtgggacagctggcttgggatgtacggcatgaagctcacggaagggcttcggctgcggatggcgtggtacatgttatcggagaccatcaccttcatcgcctggcacaaatcaaaaggaaacgacaaagcgtatcatgatgccatggaagagcttcatgccctgatgaagcggattgtcaagtagtcaggagtacgaatccatctgctccacccattgggacaaatggttttggtgctcctgaatatgcgtgtcgatggaatcggccgtgatgccggactggctgtagcggtagacatcctcgagcacgttttttatatttgaatcaagcccggtgttggccatcagtgatttgatgacgcgctccagctgttcatactcggcaaccgtgccgcagcaatccaattgatggtcggccaatatgtcctttaataaccggacctgatgttcgcttgttaagcccatgattcatatacacatcctttctgtgtcatacattgtgcaaagcggtgcggttttatgcatcacatgagtgttccggaccggggagcctctttttttatgcggccggcgcctttaaaaggcgcttgcggctctttatgtttcatggtatgttgttactcgaaattatagatagaggtgtcaatcatatgagaatgcgccataaaccttgggcgaatgattttctggcagaaaacgctgacatcgccatcagtgatccggcccagtataaagggcggtggaatacggtctttggcaatgacaacccgatccatattgaagtcggtacgggaaaagggcagttcatttcaggaatggccaagcagaatccggatatcaactatatcggaattgagctgtttaaaagcgtcatcgtcactgccgtccaaaaagtaaaggacagcggggctcataatgtccgtttgttaaatatagacgcggaaacactgaatgacgtatttgaacggggagaaatcaagcgcgtttatttaaacttttctgacccgtggccgaaaaaccgtcacgaaaagcgccgtttaacatttaaaacgttcttgaaaaaatacgaagaagtgatgggcgaaacaggtgagattcatttcaaaaccgataaccgcggtttattcgaatactctctgaaaagcttttccgaatacggcctgcttctgacagaagtcagcctagatctgcacaacagcgatccgaagggcaatattatgacagaatacgaagaaaaattctccgcactcggccagccgatttaccgggccgaagttgaatggagaacaaaagacagactctgatgcgggagtctgtttttttatgccgccatttgctaccattatatcaggagggatcaagatggagacattgaatattgggaatatttcattaacatggctggacggcggtgtaacacatatggacggcggagcgatgttcggcgttgtcccgaagcctttatggtcgagaaaataccccgtaaatgacaaaaaccagattgaattaagaacagacccgattctgatcagaacaaacggcctgaatatattggttgacgcgggtatcggcagagggaaattttctgataaacaaaaaaggaattacggtgtaacacaggaatccaatttaaaacactctcttcgtgaactcgggctttcctgtgaggacattcatattgcggcgatgacccatcttcattttgaccatgcatgcggcttgacggaatacagcggagaggagcttgtctctgttttcccgaatgcccgcattatcacttctgcaacagagtggcgcgaaatgagaaaccctaatatcagatcgaaaaatacatattggagagaaaattgggaggcggtacaagatcaggtcgaaacctttgagaacgagtatcagctgacagaaggcattacgatgcaccacaccggaggccacagcgacggccacagtgtcatcgtcttagaagacggcggggagacggctgtgcattttgccgacctgatgccgacgaatgcgcataaaaatccgttatgggtgctggcctatgatgattatccgatgacctccattccgcaaaagcagaaatggcagacgttcgcggcagaaaaaggcgcctggctgattttctatcacgacgcgatttacagagcggtaaaatggggagaagacggcgaagtggctgcatctgtcaaacgggagagaaaataagcggatcgatgatttacctgtatgaatttcgggaataaaagcaaacctaagacaaattgctttgaaaggaagagacaggtgaatcaatttcaagtgacgaaagatggagaaatcaaaacaactctgcgcggattagaagtgctttctacgccttttttaaataaaggggtggcctttacacaggaggaaagaaaggaactcgggctcgagggatttctgccgccgaaagtattgacaatcgaagagcaggcgaggcgggcctacgaacaattcagttcgcagcctgatgagctgagcaaaaatgtgtacttgaccgctctccatgatcggaatgaaacattattttacaggctgttaaatgatcatttaggcgaaatgctgccgatcgtatatacgccgaccgtcggcaccgcgatccagcgttacagccacgagtacagaaaaccccgcggtctgtatttgtcaatagatgaccctgaaggaatgcgcgccgcatttcagcagttcggaaaaaatgaaaacattgacttgatcgttgcgacagatgcggagggcattctgggaatcggtgactggggcgtcggcggcatcgccatttctgtcggaaaactcgcggtgtatacggcggccgccggaattgatccgtcacgagtgcttgcggtcgttttggacgcggggacaaatcaagaaagcctcttaaatgacccgctgtatgtcggaaaccaacattcaagagtgcgcggcgagaaatatgaccgctttattgatgagtatgtctcgcttgcccgggaaacattcccgaatgcgctgcttcattgggaggatttcggcacggctaacgcccgcggcatattaaaacggtataaagataaagtctgtacgtttaacgatgacattcaaggaacaggcgcggtgtcgcttgcagctgttttagcgtgtgcgaaagcatcaaaagtgcctttaaaagagcataaagtcgtcgtcttcggcgcgggaacggccggtatcggaattgctgagcagctgcgcgaagctatggtgcataacggattaagcgaagaagaatcatacagccgcttttggtgtatcgacagaaacggattgttgacggatgatatgaaggacttgcgtgattttcaggttccgtacgcccgccctgctgatgaagtgaaagagtacggccgcagcggtgaaggcggatcaattgatctggcggagacggtgcgacaggccaagccgacgatcctgatcggcacatctaccgtttcaggcgcatttacggaagaaatcgtcaaagaaatggcctcacatgtcaaacggccggctattttgcctatgtcaaacccgacgacattatcagaagcaaaacctgaagatttaattaaatggacggaaggccgcgcgcttgtcacaacgggaagtccgttcccgcctgttgcgtataacggcgttacctaccatatcggacaggcgaacaacgcgctcgtattcccgggactcgggctcggaacgattgtgacaaaagcaaggctcattacggacaatatgttcgttgcctgcgcgaatgccatcgccggtatggtggacgtcggcaagccgggcgcgccgatgcttccgaaagtggaggatctcaggacggtatcggcaaccgtggcggtagctgtagctaaagctgcgattcaggacggtgtagcggaaacggaacccgaggatctgatccaagcggttcaggacgcgatgtggaaccccgtatataaacgaattcggccgatgtaaccgaataaagcccaaaacgctgatggttttgggctttattttttgcttgtccgaattatgaggcgacagaatcaatgacatcgacaatctggcctgtttttgcattgaccataacttcatattgctccagttcgccgaatgccgaacgtgtcacgccggttttgtatacctggatggtttctccgtttacctggtagggctccggctctgtgtaaatccatgatccgtctatcggcccgcgctgtttaaaagccgctttcacgatacggagcgctttttctgaagagatataaggtttcatcgcatactttttcactgcgatggcagcgcataatccgactcctgcacctaagagaaaatgacgtaatttcaatatgaagcacctccaattatgtcgtagtttttattatacagaagatgccagacggtgttaagtaaagcggcggttttacagcccattcaatctgagcgcttggaaaacggttgtttttctaataaaataaaagcattacatagaaatgaggggaaaatatgaatgaggaaacgaaaacgcttttccggacgctgacgcagcttcccggcgcaccgggaaatgaacatcaggtccgctcttttatgaaacgggagcttgcgaaatatgcggatgacatcgtgcaggacagactcggaagtgttttcggagtaaggcgcggcgctgaagatgcgccgaccgttatggtagccgggcatatggatgaagtcgggtttatggtgacacagattacggataacggcatgctgagatttcagacgctcggcggctggtggagccaggtgctgcttgcccagcgtgtcgaggtgcagacggataacggaccgattatcggcgtcatctcaagcatcccgccccacattttaacggatgcccagcgcgcaaagccgatggagatcaaaaatatgatgattgatatcggtgccgatgacagagaggacgcggtcaaaatggggatcagaccgggacagcaggtcgtgccggtctgcccgttcaccccgatggccaacgagaagaaaatattgtccaaagcgtgggataaccgctacggctgcgggttaagcattgaactattaaaagagctgcacggaaaagacctgccgaacaatctgtacgccggggccaccgttcaggaggaagtcggcttgagaggggcgcagacagcggccaacatgattcagcctgatctcttcttcgcgcttgatgccagcccggcaaatgatatgagcggcgataaggagctgttcggccgtctcggcgagggggtgctgctccgcattctcgacagaacgacggtcatgcaccgcgggatgagagagttcgtccttgatatggcggaaacgcacaatatcccttatcaatatttcgcttcaggcggaggaacggatgccggacgcgtccacatatcaaacagcggggttccgtctgccgtcatcggcatttgttcaagatacattcatacaaatgccgctatcatccatgtcgatgattatgccgcggcgaaagaaatgctcattaagctggtcatggcgagtgacaaacagacggtcgaaacgatcagagaaaatgtgtaaaaaaaataagcagtcaataagtccctttgaatacttattgactgctgtttttacattctgttttaagccgcatgatcgagacagttctttgttgtgaatataagtgtaaagcgtattgtaaatagaattaggtaacacatattatttttcaatattattatcaaaatggttccgatccagataaacaaccttcgaacctttattgcaatgataaacgtttttaaatcaaaaacatgctgcaagcattgagaggagcagcgatttcacaaagtcgagtcatttgcatttttatttgttctgcaagaaggtatgattatgacaaaaaagacaaatataaactttcctcttgaactgattaatactgaagtggtgagtgtaggtaagcaggaccgcataaaagcggcctgcttattctgtttcaaataaataagagagtgctttcatcgcttgattgacggtttcgaccgtgatattcgcttttccggaaagctctttcagcggatgatgaagttctttcggacggatgagaatgagcggctttccttttgcgatggcataagaagcatccatcgcggtattccactgtttatatttctcgccaaacagggcgatcacaaaatcggctttttccatcagcacctctgtacggaaattgttgatatcagaagctctggcgtcttttaaaacagaatcgggctgcacgcccataatctcttctccgatattgtctgagcgttcatggttttccatcggaccgacaaacgtaatcggcaggttcagcgcttttgctttttgtttgatttcatcccgccaatcactgtggatttcacccgctaaatacacgacaaactgcatcttttgcccctccttatgtacatattcagattttcgtacggctacaagcaaaatggtaaacgaaacttgcttgataatgcaaatgaaatatgataatgatattgcatatagttggtcttgccgtaaacagtctggtatgatccaattggacaaacatcagcatataaaaaactcataatccagatggaggaatgacaatgaaaaagattgaaagcacggaagaattgcaaaaagcggtacaagacgattgggcggtatttatgttttcagcggattggtgcccggactgccgctttgtggagccgtttctccctgagctggaagcggactttcctgaattcacttattactacgtagaccgcgatcaatttattgatacatgcgcggaatgggaaatttacggcattccgagctttgttgtgtttaacggaggaaaagaagtgaaccgcttcgtcagcaaagaccgtaaaacaaaagaagaaattgagcaatttttaaccgattcccttgctaaagcataaaggaggccacgggctttgaaaatgacgtcaaggaagctggcggatttattaaaacagcgcctgcagcacgagaaccgatccttcttttttgacagagaaaaagacaccctccgtgttgaggatcaaacgaccaaaaaaggcatcacattggagctcccgccgatcattgcgaagtgggagacgaaaaaagaagaagcgatcgacgaaatcgtctactatgtgtcagaagcgatggaggcgatggaaggaagcggacaggagatgtccggaaaggaagccggaatctatccggtcatccgctccacgtcatttcccgatcaaacgagcgacggcattccgctcgtgtatgatgaccatacggccgaaacgagaatctactacgcgcttgacctcggcaagacgtaccgcctaattgacagccgtatgctcgagaaagaaaactggacaaaagaacggatcagggagacggcgtcattcaatctccgctctcttccttcggtcgtgaaacaggatacggttgcggataattatttttattttttcagggcgaatgacggctatgacgccagccggattctcaatgattcgattcttcatgaatataagcaggccgctgaaggcgaattggcgatttccgtcccgcatcaggatgtattaatacttgctgacattcgaaatgaatcgggttatgatattttagggcaaatgtccatgagcttctttgcaagcggcacggtgccgattacggccctttcatttctgtataatgaaggcagactggaacctgtgtttatcatggcgaaaagccggccgaaaaaggattagaaaggatttttcttatgaacgctttttacaataaagaaggtgtgggagatacgcttctgatctctcttaaagatgcagcacgcgaagaaatcggctatgaaagagaaggcgatgtcgtcagaatctttaacaaagaaacaaaagaaacgacgggctttaacatttttaacgtgtcttcttacttacagattgaagacaacggccccgtcgctttgtctgagactttcgtacaggatgtgaatgaaatactgaacagaaacggcgtttcagaaacgctgacggttgacctttctccgaaatttgttgtcggtcacgttgaatcgaaagaaaaacatccgaatgcggataaactgaatatctgccaagtgaatgtcggagaggaaacccttcaaatcgtttgcggcgcgccgaacgtggacaaagggcaaaaagtcgtcgtcgctaaagtcggtgcggtaatgccgagcggacttgtgattaaagacgctgaattaagaggcgttccgtcaagcggcatgatctgctccgcgaaagaactcgctttgccggatgcgccggcggaaaaagggattcttgttcttgaagacagccgcgaggccggcgaagcatttcaattctaactcccataaataagcgcacagaatcgaatgatgtgagagaaagccgttaagcaggcctgcttaacggctttcttcagttgggagcttaatcttttctgagccgcccggcaatggtatactaaatatcgtcccagactactaaaaagggagttagagagtgattaaacatgagttggctgaataaattttttgacttatttttaggtgaaaaagaagaagagcatgaacgtgaaccgaacacgcatgcccaaatccagaaacagcaaataccggatcagccagaaggcaaattaacgcgcatggaagattctaaaatatattacgaatatccgaaagggaatttccgcttcccggtcgttccggacggctataagcgaacggagcaaaaccaaagacagcgggaaaggcacgaacgccgccagccgtcccggggttatgccgccgggaaggagcaaacggagcggaaacagcatacacataaagagcctgatacggtgaaaaagccctttaaaccgtcatccattccttcaccggtttacggctttcaatctcagcacagcatcaaaaaagcgcctatttccgaaaagcggcgtgaagagaacgtaacattgctgtcagaggagcaatttgttccgccaaaatccggtcaggaaacggaaaaagagcccgtcttcacaacatccggtataacaaaacagacgaatgaccggccagaaccgtttgcgaaacaagaaacggaagaaattccggccgttaaaaaagaggagcttcacacggaggctgagaatgcaaaagagcaagtgtttgcagcaccagaaccgcagcaggctgaagagctggagcacaccgaaagcgcggagtctgccggctttacagaagaacaagagcatgaacaaacccgcccgcagcctataagagagcctgagtctgaagcatcccgaacggctgaaaacacagaggaacaagcggcgccggagggggaacatcaggagcctgagccggaaaaagcaccgccttttgaaaccgcagaagaaccggtgtatacatacacagaacccggatacgaggaaattcagccgcagtctgaagacaagcccgaatcagctgaacccgacgcgaaacaggaagcagactctcagcctgagtacaatgaagcagagcggcattcagaccccgagcctgaacctgtaagcattgagacgaccgatgccccatcccggcctgccgaagaaaaaacggagcatcacggacagcctcagactgtgagaaaagcggagcagccgaaagagcgcaatgttccgtttaacgtcatgatgcttaaaagcgataaacacaagcagacgaagacgccagagggcggagcgagctatgtctttccgaatctgtcgcttctggacgtaccgccggcgcaaagacatgacgaccaatcgtggattgaagaacagcgcgagcttttaaacgttacactgaaaaactttaatgtgcgcgcccaagtcgttcatgtcacacaaggcccgtccgtcacacgttttgaagtgcatcctgagcccggagtgaaagtaaacaaaattacaaacttagcagatgatattaaactgagcctgtctgccaaggatattcggattgaggcgccgatccccggtaaaaacacgatcggcattgaagttccgaaccgcgtaagcaaagtcgtcgatttaaggcagatgatcagaagcgccgctttcaggacgaatccgtctccgcttacagccgcgctcggtgtcgatatttccggaaacccggtcgtcattgatttgaaaaagatgccgcacgggttgatagcgggtgcgacaggatcgggaaaaagcgtctgcatcaataccattttggtcagtctgctttataaggcggatccgagtgatgtcaaaatgcttctgattgatccgaaaatggtcgagcttgcgccttataaccaaattccgcatttggtcagccccgtcatcacggacgccaaagccgcgaccgccgcgttaaaatgggttgtggaagagatggaacggcggtatgaactgtttgcccattcgggtgtgagagatatcggacgctttaatgaattaacggccgatcataagacaggcgaaaagctcccttacctcgtagtggtcattgatgagcttgccgatttaatgatggtcgcgccgaacgatgtggaagaaagcatcgccagaatcgcgcagaaagcgagagcctgcggcattcatctgcttgtcgcgacacagcgtccgtctgtcgatgtcattaccggaatgatcaaggcgaacataccgacgaggattgcattctccgtctcaagccaggtagattccagaacgatcatcgacatggcgggagcggaaaagctgctcggaaaaggcgacatgctgtactgggaaaacggtaccggaaaaccggtgcgcctgcagggcaactttgtatccgacagagagattgaccgcgtcgtctctcatgtcagaaagcagctgccgccttcttatttgtttgaacaggaagaactgatcaggcagggaaccgcccttaaggaagaagacgaactgtttcctgaggcgtgccaattcgtcgtggagcaaaacagcgccagcacctcaagccttcaaagaaggttcagaatcggttataaccgcgccgcgaggctgattgacatgatggaagccgaaggcatgatctcagaagcgaagggcagcaaaccgcgtgaagtgctgattacggccgctgacatttctcaagaataagaatatcgttcatttttctcacaaacatggtatgatagtggatggaccatcaaaactgcatcactgtcacgcgctgaaatatcatgcggcaggtttaatcaaaaagaaagttacagatactgacgataacgtaaaaataaatggaagcgccgctgtgcgggcttttcgcccgctgcggtcgcaaaatgaaatgagcgtcatatactggggaacagatagacgtttgttggaggtacgattatgactgtttatcattttgttggaataaaagggacaggtatgagcccgcttgctcaaatcctgcatgatacggggtatcaggtgcagggatcggatatcgagaagcagattttcactcaggctgcccttgaaaaaagaaatatcccgatctatccgttcagcgccgataacatcaaacccggcttaacggtaatcgccggaaacgcattccctgattctcatccggaaattgcaaaggcgctcgatgaagggattcctgtcatcagatatcataaatttttagctgaatatatgaaaaaatacacaagtgtcgcggtaacgggcgcacacggcaagacgtccacaacgggcctcttggcacacgtgatgcagcaggcgaagccgacttcgtttcttatcggggacggaacgggcagaggaaatgaaagcagcgaatactttgtatttgaagcttgcgagtaccgccgtcatttcttaagctatcagcctgattatgcgattatgacgaatattgattttgaccaccctgattatttcgccaacattgacgatgtgtttgatgctttccaaaacatggcgcttcaagtcaacaaaggcatcattgcctgcggtgatgacgagtacctgccgaaaattcacgccaatgtgcctgtcgtttattacggcacgggagaagaaaacgattttcaagcgagaaacatcgtaaaaaatacggaaggcacgacatttgacgtctttgtccgcaatacgttttacgatacgttctacatcccggcatacggccatcataatgtcctcaattccttagcggtcattgcgctctgccactatgaagaaatagacgtgaacatgattaagctcggacttgaatcattcggcggcgtcaaacgcagattcaatgaaaaagtgatcggcagccaggtactgatcgacgactacgcccaccatccgactgaaatcaaagtcacgattgaggcggcgcgccaaaaatatcccgaacgtgaaatcatcgcggtatttcagccgcatacgtttacacggacgcaatcattcctggatgaattcgcagaaagcttaagcgcggccgaccgcgtgtatctgtgcgacattttcggctctgcccgtgagaacgtcggcaagctcacgatcacggatcttcaggaaaaaatcgataacgcagaactcattgaagaaaatgacacttccgtgttaaaagcgcatgaaggcgcagtactgatcttcatgggcgccggagacattcaaaaatatatgagggcctatgaaaacgtcatagcgtaacgaaaaagcagtggggctctcactgcttttttgcgcgtgctgcaaagggatttaccgataaacggagaaatagtatacatacagacctttcatatatgtttatcattttaagaattgggtatataccactatatcctgcattaaggaggtattagatgatcatcattctttacttaagcgtcgcactcattgccgttgcatttctcatcctcgtcatctatctgtccaaaacattaaagtccgtgcagatgactttaacaaacgtagcctcgactttagacggccttgaagggcagatgaaaggcattaccgcagagacaaccgagctgttacataagacaaaccgtctcgcggaagacattcaggaaaaatcagagaaattaaatacggttgtccatgctgtccaggaagtgggaacttccgtccagcagtttaatacatccataaagcaggcagcaggttctgttacggcctctgtaagagagaatcaggataagatcagtcaggttgtcacctggagccaggccgctatggaaatatgggacaagtggaagcaaaagaaaaaaacatcgctttaatcataagaaaaatccactaaggaggaatcataatgagcaaagatggaatcaatagtaaggattttttaatcggaacgctgatcgggggaattatcggcgcgacaacggcgttgtttctggcgcctaaatcaggtaaggagctgcgcgacgatctcggcagtcaggcttctgcgttaaaggataagacggacagaatgacggccgacgcgaaagaaaaaggctctcaatatgtcagcatcgccaaggacaaaacatctaatatcacccagctggtagctgatcagtcaggtcagattatgaataaagtgaaggatttaaaagaccgttctaagagcacactaaccgagaaagccgaagagacgagaagcgaaatgcaggacacggcccaaagcatcaaggccgaagcggaagacgccggggaaaaagccggtcaggcaaatcgctgatcttcaataaggagagataaccgacatgacaaaacagctgatatcgtctgaagaagagttcaaaaatgccgctgagaaagaaaacacgctcgtgtttttaaaacacagcacaacctgcccgatcagccaagccgcgtttcaggagtttgacgcctttgcatcggagcattcagaagtaccttcttattacctgcatgtgcaggacagccggccgctttcaaactatatcgccgaggcatacggcgtgaaacatgaaagcccgcaagtattcgttattacaaacggcgaagtgaaatggcacgcgtctcattcacaaatcacaaaaaacgcaatagagcagcacctttcataattgctggccgccggttgataccggcggtttttttttgaaaaaaactattgatcatttcagccggatcatgtaggatatcaatatatactgcttcaacgcataaaagcttaaaagcgtttttgtgataaagtcgaatgtgaaaaaatttattatttcatattcctattttcgcataactgtagtaagatgcatgttaaccattaaaataaaacatagcatagaagggatgaaaaagatgagcaacaaggaattagagagtctaagacagcaggcagacgcactaaacttagaaatccttaaattaatcaatgaacgcggagccgttgtaaaagaaatcggtaaagcaaaggaagcacagggtgtcaaccgatttgaccctgtcagagagcgtacaatgcttaaccgcattattgaaagcaatgacggcccatttgaaaactcaacgatccagcatattttcaaagaaattttcaaagccggacttgaacttcaagaagaggatcacagcaaagcgttgctcgtctcccggaagaaaaaagcagaagatacgatcgttgacattaaaggtgaaaaaatcggtgacggcgatcagagattcatcgtcggaccttgtgccgtagaaagctatgagcaggttgccgaagtcgcggccgcagcgaaaaaacaaggcattaaaatcctgcgcgggggcgcgtttaaaccccgcacaagtccgtatgatttccaaggtctcggcgtagaaggcctgcaaattcttaaacgcgtcgctgatgaatatgacctcgcggtgatcagtgaaatcgtaacgcccgcccacattgagcaagcgattgattacattgacgtcattcagatcggcgcgcggaacatgcaaaactttgaattgctgaaagccgccggttccgttaaaaagccggtattgttaaaacgcggtcttgccgcaacaatttcagagttcatcaatgcagctgaatacatcatgtcacaaggaaacgaccaaatcattctttgtgagcgcggaatcagaacgtacgaaacggcaacgagaaacacactcgacatttctgccgtgccgattttgaaacaggaaactcacttgccggtgtttgttgacgtcacacactcaacaggccgccgcgatctcctgcttccgacagcaaaagcggcgcttgcgatcggcgctgacggcgtgatggccgaagtacaccctgatccttccgttgccctttcagactctgcgcagcagatggatatccctgaattcgagaaatggctgaacgaattaaagccgatgctgaaagtaaaagcataatacaacgttccgctctttaaaggccgcctcgcgcggcttttttttcgtatcttcattttatttaattataaaatgaaagtgaacgttttcatcattgggaaaaacgtgtataatttcatgagagatatttaaatttgatgaataatgaaaaataatgtacactactgacttacgcttacaatcataaacgacagaatgcgaaatcgtacgacatttctttacataaagtgtttatgctatagataaggataagtgtatccagtaaaaggagtggtttcagtgagcaacattacgatatacgatgtggccagagaagcaaatgtcagtatggcgactgtttcccgcgtcgtgaacggcaacccgaatgtaaaaccgacgaccagaaaaaaagtattggaagccattgaccggctcggctaccgcccgaacgcggtggcaagagggcttgcaagcaaaaaaacgacaacggtcggcgtcatcatccctgatatctcaagcattttctactcggaacttgcgcgtggaattgaagatatcgcgacgatgtacaaatataatattatcttaagcaactcggatcaaaatcttgagaaagaactgcatctgttaaatacgatgctcggcaaacaagtggacggtatcgtatttatgggcggcaacattacggacgagcatgtcgaagaatttaagcgctctcctgtgccgatcgtcttggctgcatcagtggaagaacagggcgagacgccttctgtcgccattgattatgaacaggcgatttatgatgccgttaagcttttcattgataaagggcatcgcgatattgcattcgtctccggaccgatgcaagagccgatcaaccgttcgaaaaaactgcaagggtacaaacgggcgcttgaagaagcggcgattccgtttaacgagcaattcgtagcggaaggcgattacacttatgattccggtatggaggcgcttcaaagcttgatgggccttgaccggaaaccgacggcgattctttctgcgacggatgaaatggccctcggcattatccatgcggcccaagatcaaggtctttcgatacctgatgatcttgatattatcggttttgacaatacgagattgagcctgatggtccgccctcagctttcaacagtcgtgcagcctacgtacgatatcggcgccgtggcgatgagacttttgacaaaactgatgaacaaagagccggttgaagagcatatcgtcgaattgcctcaccgcatcgaattaagacaatcaaccaagtcataaaaaaacggaaaagcaagcttcactctgaggggtggaatcttgcttttttacttgagtaaggagaagatatgaaacgttttgattatctgacgcccgttggctttatgttaggctgtattattgtcgcaatcggtattctgtcagggacgggactggcgggaatcagttcatttttggatctgacttcttttttaatcgtcacaggcggccttgccgcggcggtctttatcagctttccgccgagggatttaaagaaaaccccttctgttctgaaacaggtattctcccgtcaggatgacaatgtgaaagagcttgtcagagtatttgtcagcctttcggagcaggcgcgcaggcaggggctgctgtctctggatgaccaggcgcgggagatcaaggatccgtttttaaaaaaagggcttttgcttgcgattgacggctgggacgaggaaacgatccggctggtgatggattctgagatcgccgcaatggaagaaagacacagaaaaggaagacgcgtttttgaaaaagctggtgatttcgcacccgcctggggaatgatcgggacgctcgtcggactcgttctcatgctcaaaaacttaaatgacccgcataccctcggaccgaacatggccgttgcgctattgacgacgctgtacggagcgctgcttgccaatttggtgtttatcccaatcgcggcaaagcttgaagaaaaaacggaaagtgaaattttcatcaaacaggtcatgatcgaaggggttgtcggcatccaatcgggcaaaaatccccgcaacctcgaaagtcagctcgtcgtcttcagctcaagagaagactggcgtaaaggacagcctgcgaacaagaaaaagggcgctgtccatgaagcttagaaaagagcgttttgaaagaagaaacaaaccggaacattccggcggttcaccgagatggatggtgacgttcgctgacttgatcacgctcattctcgtgttctttatcttgcttttttcgatgtcgcaaatagacgcggaaaaatttcaatctgccgtttcatcgattcatacaaacggcagcggaggtgaaccggcgtcatcagacaaagcaaacgaaaataaagaacaggatttgctgttacaaaacgtgaagacatacataaaagcgcatcatttgagttccaaattgacggcgaagcgcgatgagcgcggagtggttcttgtgctgcaggaggccgttctgtttcagacgggaaaagcggatgtgctgaaaaacgccgagccggttctgcatcagatcgcggtgcttttaaaaacaattccgaatgacatacaggtagaaggccatacggacagccgccggatttccacctatcaattcccgtcgaactgggagctgtcgtctgcaagagcggcgagtgtgatccagtattttaccgcgaatgaagacttttccgccaaacggtttatctctgccgggtatgcggatacgaaacctgtgaaggacaacaaaagtcccggacatatgaaagaaaaccgccgtgtagaaatcgtgatcaaaaaaacgacctcctcataaggtcgttttttattttgttttataccgctgctcagaccggatggcaaaaagtgctttttccacggtttgggcatttttttctgaaatttcttctttgcgtggaatcggaggatataattgttcaggatcactccaaaaagcgggcagcgtgcagggggaatgcttctgccatttatcaatccatttctgcggtatgcgctccccgggatcaatccctttcatctcaagccaaatgcggctccatgctctcgggacgactctccaaatatcgtatccgccgccgccgaccgcgatccatctgccgctgcaatattgatgggctaatgaatgagcgagccgcgggatctcctgataaatggagattgtattggacaggtgtgtcaatgggtcgtaataatgggcgtccgcaccgttttgggtaagaatcacatccggcttaaaaaaagccgcaatttcagaggcggccgttttgtaagcgtggagaaaggaatcgtcctctgtgaaagcgtccagcggaatgttaaaagaatagccgtagccttgcccgcttcctttttccagtacttgtcccgtcccgggaaataaataacgcccggtctcgtgaaaagaaacagtgcagacatcagacctgtcgtaaaacgtaaattgaacgccgtcgccgtggtgggcgtctgtatcaatgtataacacttttgccccgtagttcttctggatgtattggatggccacggcgctgtcattatagatacaaaagcctgacgccctgccgcggaagccgtggtgaaggcctcctcctaaattgcaggcatgcctggcttgtcccgtcatgacataatctgccgccgttaaggtgccgcccaccagaagcgacgcagcttcatgcatgccggcaaaaacgggggtgtcttccgttccgagaccgtagctttctccttctgcggcagggagccggcccgcacccgcaagttccaccgcctgtatataatcctccgtatgaacgagagccagctcttctttagtggccgtgcgcggtttgacgatgtctccatcgtcaaacgcgtccgccgcctgaagcagatcgtatgttaaaagcacgcgctgctgattgaacggatgatcctgatgaaattgatacgtctgataagaaggcgagtaaacaaaaacgctgtctctcatggctgatccctcaaatgtttcggccataagacattgtatccggcttcatgaacggcacggataaaagggagcggattcatcgtcttcacccggaagacgagaatgttcgacccggcggaatcatggggatagacgagcacactcaggatttgcagctgaagatcacggcacatgcagctgagatcagcaaggctttttgtcatatccgtcaccaggatttccacctgtgatcccggctgggccgcgcctgtcaggctgacgaaagtccggagcacgtcggttttcgttaaaatgcccgtcagcttatgatttaccgtaatcggcagacagccgatgccgtgctcataaaaggaagcggatatttcttccacaaagtcaagcggatgggcgcagatgacattccgcttcataatggtctccactttgtttgtcagaaacgcgccgcgttccttttgttcgaagctgccggggccggcctgtttaatgtctctgtctgtgacaataccggtgacgtgcagctcgtcgtcgatgacagggagatggcggatatgatataccttcattttacggacggctgtttcaatggagtcgtgttttgagacggtgatgacgtcccgtttcatgatttgttctgcaatcatctttttatcccctttgtatgtcagtcaatacataaaccgctgataaaaacgaagcctgtcgaactgttcaattgactcctgactgacgtgcctgccgatgcgggccatcagacaattggccggatgagagctgatttccggttcatccgttgcaaaccagacaagacccccggcattcatcatcttttccatgatctttctgtattcccacacatcttttttcattccttttaaatcccaatgccagtaatattccgtcgtcatgatgatgtagcgttccatctgttcatccatcatgctgactgtcagcaacgtttttccgacagaacagccctgtagccgggagcgacctcgatcgccccgagctcaaggagatcttccatattgccgtcagaccaccgttcaagcggatcaggatataaatacgtcacatagccgataatcgtctgtccgtccctggcgataatgatccgaccttcaggaagcccggcgatctcgattaacgctttgtgctgttcatgaggaaggcgaaaggctgtcaggccttcatgaaactcatactgtgctaggtcctttggaggaacgggcccttctaccaatagagggccggctgctgtctgaattgatgaagaatggtacgttttatgatgtttcactgattcaccgcctgtcggttcttaataaaaacacatctctcttaagcataacaaaatataaagcgttttcaatagtgttgtaatttatattttaaaaattgagaaaactgtgaacatctactataattagtctatagataagcaaagggggatgttgcatgaatttgaaagcgttgccggcggaaaaggggaattatcatctgcgaaattatgaggaaacgtaccgcagcttcgattggaaagaggtcgaagcggagttttcctggcatcagacggggaagctgaatgcggcgtacgaagcaattgaccgtcatgccgaatcatttcgaaaaaacaaagtagcgctgtattacaaggacgcaaatcggaatgaaaaatacacatttaaagaaatgatggaggaatcgaaccgggcgggaaatgtactgagacggtatggaaacgtggaaaaaggggaccgcgtttttattttcatgccgcgttcgccggagctgtactttatcatgctcggcgcaattaaaatcggtgcgatcgccggccctttatttgaagcgtttatggaaggcgccgtcaaagaccgcctgttgaacagccaggcaaaggttgtcgtgacgacacctgaactggccgaacggattccggcggacagcctgcccgacctcgagcatattttcattgtcggcggcagcaaagaagcgggagataaaatcattcattatgataaagcggctgagggagaaagcacgagacttgatattgaatggatggacagaagagacggctacctgcttcactacacatcaggatctaccggaacgcccaaaggtgtgctccacgttcatgaagccatgattcagcaataccagaccggcaagtgggtgcttgatcttaaagaagacgatatttattggtgcactgcggacccgggctgggtgaccgggacggtgtacgggatatttgcgccgtggctgaacggagcggcgaatgtgatcgtcggcggcagattcagtccggaaaactggtacggcacgattgagaagctcggtgtcagtgtctggtacagcgctccgacggctttcagaatgcttatgggcgccggagatgaaatggcatccaaatttgaccttacttcacttcgtcacgtcctgagtgtcggagaacctttgaaccccgaggtcatcaagtggggacataaagtattcggcaagcgcatccacgacacgtggtggatgacagaaacgggcggacagctcatctgcaattatccttgcatggagatcaagccgggctcaatggggaaaccgattccgggagtggaagcggcgatcgttgacaatcagggaaatgagcttccgccgtaccgaatgggaaatctcgccattaaaaagggctggccgtcgatgatggattccatttggaacaacaaagagaaatatgattcttattttatgccgggcggctggtatgtttccggagattctgcttatatggatgaagacggttatttttggttccaaggcagagtcgatgatgtcatcatgacatccggcgagcgcgtcggcccgtttgaagtcgaaagcaaacttgttgaacatccggcgattgccgaagccggcgtcatcggaaagccggaccctgtccggggagaaattattaaagcgtttatcgcgctcagagaagggcatgagccatccgatcagctgaaggaggacattcgcctctttgtaaaacaggggcttgccgcgcatgccgcaccgcgggaaattgaattcaaagataaacttccgaaaacacggagcggaaaaatcatgagacgtgtgctgaaggcatgggagctgaacctgccggcaggcgacctgtccacaatggaagattaaagacggcgttgacatcgtatcttatttatgttaaaaatgagtaagcttcatacgaaaaggttttgattgagacaagtaggatatctgattgttccagagagctgatggccggtgaaaatcagcacataagatatgccgaatacactcatgaaccgcttttgcgaacaaagctattccaaggctttcagtagtgaaagaacggacacggtccgttatcaaaaagagtgataaaagcttttttatgtttttattagtagggtggtaccgcgattatatcgtcccttcgttttaaacgaaggggcgttttttattttcataaacaaaggagcagacaaaatgactaacttattagaggatttatcattccgcggcttaatccagcaaatgacggatgaagaaggactgaataaacagctgagcgaagaaaaaatccgtttatactcagggtttgacccgacggctgacagcctgcacatcggacaccttctgccgatattgacactgcgccgtttccagcttgcaggccaccatccgattgcgcttgtaggcggcgcgacgggactgatcggcgatccgagcggcaaaaaagcggagcgtacgttaaatactcaggatatcgttgtcgaatggtcgcaaaaaattaaaaatcagctttcccgatttttagatttcgaggcaggagaaaaccccgctgtcatagcgaacaactttgattggatcggaaagctgagcatcattgaatttctccgtgacgtcggaaagaacttcggaattaactacatgcttgcgaaagatactgtaagctcaagaattgaaaccggaatttcttacacggaattcagctacatgatcctgcaatcctacgattttctgaatctgtacagagaaaagaactgcaaactccaaatcggaggcagtgaccagtggggcaacatcacggccggtcttgaactgatcagaaaatcagaagaagaaggggcgaaagctttcggtcttaccattccgctcgtcacaaaagctgacggcacgaaattcggcaaaacggaaggcggcgccatttggcttgataaagaaaaaacatcgccgtacgaattctaccagttctggatcaatactgatgaccgcgacgtcgtcaaatacttaaaatactttactttcttgtcaaaagaggaaattgaagcttatgctgaaaaaacggagacagctcctgagaaaagagaagcgcagaaacgtctcgctgaagaggtgacggttcttgtacacggccgtgaagcgcttgagcaggccgttcatatctcccaggcgctgttcagcggcaatattaaagagctttccgctcaagacgtcaaggtaggatttaaagatgtaccttcgtttgaaaaagaccgctctcaagaactgtctttagtagacgtgctagtggaatctaaactgtcgccttcaaaacggcaggcccgcgaagacattcaaaacggagctgtttacattaacggcgagcgccagacggacatcgggcatcttctgactgcggaagaccgcattgaagatcaatttaccgtactgcgccgcggaaagaaaaaatacttcctgatcacgtactgaaaataaaaagcagtccggccgctccatgcggcaggctgcttttttatgttttgtgaatactgcacggggaaatgagtacagtacatagtataagcaaaacagggaaggggtgctgcgccgtgaatttcatgtttaccatcgccaaagaaagattgcagcgggatcattgggaacagcagcaaagcataaacgccgaagccgaggaatcagagacggaagaagaaaatccgacatcataaaggtaaagcctccattctatggaatggaggcttttgattgtcaccatatcagcctgacggcggccatcagcacgactcccgtgatgaccgtgatggataagctttttgtcagcatcgcgcaaagcaatgtcgggatgagaacgatcattgctttccaatcaaaggtcaaagcgctgtttgttttcacaatcatgttttccgttaccagagccgtcaaaatgcaaagcggaataaaggagagccattttaaagccaattcaggcatctgaatgttccggacaaatataaacggaacaatgcgcggcacaagtgtaacaatcatgcagccgagtataatccagatcatttgtgtgctgatgctcatttgtccgtcaccaccccgatcgttgccacaattacggttgagacgatgaccgcgatgtgtgacgggacgaaatacgataacaagaccataaaaatgatcatatagagaattaaggagaggctgtgcttcagcttttccgaagcggacgactgcaattgcagcacaagcagcgccgcaaacatagcgggcaaagcaaagtccaggccgagagcgtaaggatcagatatccattgtccgagaagcccgcccatcacgcaggaaataacccagcacatgtaagcggttatattgaggccgttcatccacttatcgtataacctgccgttctgagccgctttgttcaccgctactccgaaagattcgtcagtaagcagagccccgaagccgatatttttcgccagagagtatttcgtgaaatacggcgcgatggtcaggctcagcagaaggtgacgcagattgacgataaacgtcgttaaaataatggcggaaatcggactcccggaaacaaggagcgagcaaataataaattgggcggcgccggcatagacacacaaggataacaaacagatttcaagaatgcttagatgagaggcaaccccgacgatgccgaaagcaaaaccgatgctcatatagcccagcagcgtaggcacacaatcccgcaccccctgtaaaaacgtatcgttcatttcccgggaaacggcggttttttgcacttctgtattaatcattttttatactcctttcatagagattataatgataacgactaatgaaaaaatcaaagaaaatacggttcacatttatatgaaccgatttccggtgacgacatgaaataacgaatggttttgtttcatcaggccttcaactttttcagccccgacttctttcacaagctctgcgaacatcagatcgtgcctcatatattccatggccacgagaacgagagcggggtcttctgatttaatggcccaggcattcgtctgcggagaaaaattggcgattaagacttctttattatctcgggcagctatcgttaatcttccgcccatccgtttctccgccacttcaggagacatattatgatttgtcgtatttccgagcttcacttccggagggccgaacacaatcgaaaagacgggcaattgttcggcggcgcgtttattagcggcttcttgaataaagggaatctgctgttcccagacagacagccacaactcttcctcggctttttcaatcatttccttcatctcattgatgacatgatcatttgtgctgatgcggcggatgacattcatctcctgctcgctttccagcgccaataacttttcctcaaggtagccgaatgagctctcgaaatcgtgccggagccggtcgattaattcctttccggccagcggggcatatgtaaccggatcagacggcacaatatggacagcgcctttatcaactaatttccccaatacctcatagatcattgagcgggggacgcctgaccttttgctgatttcatatccggtaacaggcgagtgtttcaacaagccgatatatgctttacattcatattgagaaaatccaaacttctgtaattctttcagaacatcatccataaacatcctccgtagtggttattcatgaaactactataatgtaagcggttatatcttgtcaatgggacttgagtgctgaaagaaaggttcgcctgttttgtcgctttccaacttagtttatgatgagttacatgtatggcttttgtgaaaaacgttgccgtagacccacacgaatgccgtttgatacgataaatacaagaagtcaaaaagaggaggatcacggtggaaaacacctctaaaatcgcttttttatcggttataagcaattccctggtcgtcatgctcaaaatagtggtggggataataaccggatctgtcgcgatactttcagaagccattcattcttttttagatttgatcgccgccttcatcgcctttatctccgtcaggatttcaaaaaagccggctgatacagggcatccgtacggtcatggaaaagtcgagaatctgtcggggaccatcgagacgatgctgatttttgcggcagggatttggatgatatatgaatgcgttcaaaaactggtcaacccggctccggttcatctgcccgtattgggaatcgttgtgatgcttgcgggggctctcattaatttgatcgtttcgaagttcgtaaaaagagaagccgaaaaggttaattccgtggcaatgaaatcgaatgccctgcatttactgactgacgtgtacacatcattaggcgtagcggcaagccttttggtcgttaccttaacggagtggtacatacttgatcctattataggtatggtgctggcggtgtatatcatatatgaagcgtttaagttaatgaaagaagcattcccgccgctgattgatacccgtttgtcggaagaggaagaaaaaacaattttaaagattatcgaaacatttcaacaggaatttattgaaattcacgattttcgtacaagacgctccggcccgcaggagtatattgattttcacttggtcgtagcctctcacgtggcgattaaagacgtgcacgacctgtgtgaccgcattgaaagagctattacgaatgaattcaaacaagcacaggtaatgattcaccccgagccggagagcgagaggaagaaataaatcgatcttaagtttgcgtttgttccctgcaaaatgcctgcaaaaggcccgtttccacgggtctttttgttgtataaatgactatttctcgctcatatgagagagaagcttatacacgtgaggggtacatttcatacgttatgttgtaaagaaaaagggaggtgaacagaattgaacgctatttctgttaaagaaattgaacatggagttgccgttgcggaaagagaaggtttaggggagtatttataccaagaaccggtttccaaaaaatgttcgcgccgttcccgcagcagaaaacggacacaccgttcccgcagcagaagacggagtcatcaccggacacaccgctcccgcagcagaagacggacccatcaccggacacaccgttcccgcagcagaagacggacgcatcaccggacacaccgttcccgcagcagaagacggacgcatcgccggacacaccgttcccgcagcagacggtcacatcaaaaacgtacccgcaagcgctgttttaaatgctgaagcagactctattacaagtaatggagatctgctataatggcaagagaactgcataaaagatccggtatcatcatctgcggacactgaactgacaacatggcgctgtttgttcgtgtccgttttttatgtcaaaaaagatgccggaggataaaaaggaagggatgacgccgaatgaagctgaatgaggaattttataactctgaaggaaagacagtctcttcgcaaaacataagcagcaagcttttgcatatcacggacagcgggcatatcagcattgacttcatcagcataagcaggctgcggaaggcttcaaaaatcgcgatcttaggtgacagcgtcgcccgggggctgcgcgcggaatacggctttggtgacattctgaaagaccggacagacgctgaaataaccaatctgtctgtcagcggcgttaatatgagcaaccacggaagcgataacatttatcagcaagcgcttaaaacaaagggacatgatgtcatcattgtccagggaacagatgatgattggtgcaaccacattcccatcggcacagatgaaaaggatatcaccacattttacggaggcttctgtcaagtgattcagcagctgcgaagcggaaataaaggcgcgagcaccattgtggtgaccccaacgagacaagcaaaaatatcaaaaggaaaaatcgtccgccgtgatactgataaaaataaactgggcctgaagctggctgactatgtgaaagcccaaaaagaagcctgcacactcctctctgtaccgtatgccgacctgtttgatacagatctcatcgacccgtataatcccgctttccgcagcatgtgcatgtcagaaggtcttcatccgaacgagaaagggcatcaaatcatttttcaggaaatctgccggaattattattactattacgggtaacacagcgctgcatgattattttcggccttgcttttctaaaagctcaattattctttgagatgcgtgtttttgcgctctcaaaagcgaaatgatattaccggtaaaaccgattaaaatgatcagcagcaaaatgatcatccacataagtgaacctcccgtcgagtgttgaaaaacccactctttattttacttattatggatggggaagagaataggtctaactattggtgtttctttatcaatccataaaaaaatgcacagactgaacgggtctgtgcatttttattcgcttatttcagcaggttcaatgattcacgattaaaggcttccaaatcgtcaggcgttctgctcgttacgatgttatggctcacgatgacttcttcatctttataatgtgcgccggcattgattaagtctttgcggatgctgcggaatcccgtgatatcttttcctttaagaaggtcggtatcaatcagcagctgcgggccgtggcagatcgcgaaaacgggtttctgattttccacgaatgatttagtgaattcacccgggcggtcatctccccgcagaagatctggtgaaaagcctccgggaatcaataacgcatcgaattccttggggtctgcgtctgagatcgcttgatcgatctttactttctcaccgtgcttgcccgtcacttctttccctgcttctaaatctattgtcaccacactgtggcccgcttctttaaatgcttccgccgggcttgtatattcaatatcctcaaattgatctgtcatcagaactgcgatttttttgctcatcatcatgcctcctgtgaatttgtatatgacaagaatatcaggcggattgccgcctcacaacgtatttgcttgaagatacggcatgaaaaaagacccctctgaaaaagaggagccaaaaggtacggaggtctgctgaggcaagaaatcgaaccaattactttttgcgtctttttttatcctttttacacccgcatttccccggatcgcccggatcaatgacttcgtgaattgtttcttcctgataaacgtggcggggaacataacggatatgttctctgttaatgtgtttgatgggatggacgtaaaccacttctttgtcagtatacttgtcagtcacaatatacttagggtcacagtaatacactttcgattttttacccattcatctcacctcccgtactttattaaatgctgaaaaggaggattttgcatcggacaagtacactatggcaagtccacaattttccatccgcaatttcgtttatctggtttttcctgaatccgtctcaaattggaatggctaaccctttttgaacggggaaatctataaaaaagaattcaaaaacgattcttttttcaggtcaatcgagatgcatacatctttagggggatttcagaatgctcgatgaaaaaacgattgaaatcattaaaagcacagtgccggtcttagaagagcatggtgaagaaatcacaggccgattttatgacctgctttttcagcatcaccctgagctgctgaatatctttaatcagacgaatcaaaagaaaaaaacacagcgtacggccttgtcgaatgctgtgattgcggccgcagccaatattgaccggctggaaaacatagtccccgtcgtcaaacaaatcagccataagcaccggagtatcggtgttaagcccgagcattatccaatcgttggaaagtacttgttaatcgcgataaaggatgtgctaaaagacggggctgctcctgaggtcattcaggcatgggaaaaagcatacggcgtcattgcagacgcttttatcggaattgagaaggacatgtataaacaagcggaaacgcaaaaaggcggctggaaagacgataaggcgtttaaaattgataaaaaggtaaaagaaagcaaagagataacgtcgttttatttaaaaccggaagacggacaagttctccccgaattcaaagcgggacagtatatcagtgtaaaagtatacattccggacacgggttatacgcatatccgccagtacagtttgtcggatgtatccggtaaggattattaccggatttccgtgaaaaaagacggaattgtttcttcatatctgcatgaccaattacacgaaaaggattcaattgagatcagcgctccggccggggatttcgtattagaccctgattccaaaaagaatctggttctcatcagtgccggtgtcggaattaccccgatgatcagcatgttaaagacggttgccaaaacccagccgcagcgaaacgttctctttatccatgcggcaaggagcggagagtatcatgcgctgcggcatgaagctgaagaagccgcggaacactcatccgctgacaccgtctttatttacagcgaaccgtccgaacaagaccgttcagaaaacattcgttttcgggaaggccggattgacaaacagctgttagaagaagtgatgacagataaagatgctgatttttacctgtgcggatccccgtcgttcattaaagaaatgaaaaagctgatttctgaattcaatataacgccggaatccattcactatgaattatttaaaccgcagctgagtatggtgtgatgtaacaacatcttagacagtctgtttaacagactgtctttatatgtttaatacgaaaggttttccccataacatagaattttcaagcaggtaaatcatattcaaagtcgtattatcctaaaaagacaaagttttttatgtcccaacatacttcagtagccggatggaaaggttctcttcctgatacttcaactggaacattggctcctgctcttgtgaataaaatagcaatgctctaataataagaggtggctcaatggcagtttttgttgaaaaaacgctccaaggtctaaaagaattaattgatgaaaaaggccgcttgaacattttagggaatgaaggaacgcttttagaaacagaatgtactttctttaaaggtgcaacagatctggagattgagagttttgagaagaaaataaaagtctcacttcctgaagattataaaacctttttaaaattgcataacggagccagaatatttgatttgttgatttacggtgagaatgtaggtgggggtttgcatattcttgatttagaagagattgaaaagtatatgcaaaatggttttttagagcctcagtttattcctgtcgcacatctgttagacggatgttatttgttaattgacaaaaccaaaatttctacagatccaaactatttatggttccgcggatttattgagtatgaaccaatgaaacttaattttgagatatttttagatcggtatattttgtgtcaaggagcaaatttttgggagtggaatatctataccgctgaaaattattataggactcaccagggtgataaggattaacctttcctacagttgggttggttcatttttgcggttagacttcgatttgaacttttaaaaataggtttaatttgggagacgaaccgattaattggtgtatagatgatttataaaaagcgcagatactctgcgcttttttatttaagtattttccggatcattcgcagcccgtttttggaagaaggataacggaaagcgaggtcgaagcggttcgtttgtttgacgacgctttttttgtgcgtaaatgcgttaaagctgttaaatccgtgatagctgccgatgccgctttctccgacgccgccgaatggcaaatacggtgtcgcgacgtgcattaacgtatcattgacacagccgccgccaaatgacagattctctaaaacagttcgctcgattcctttgtttgttgtgaagacataaagagcgagcggctttgggcgtgattggactttctcgatgacttcatcgatatcgccgtatgtaaacagcggaagaatcggcccgaaaatctcctcctgcattactggagagtcatccttcacttgatctagaatcgtcggcgctattttgtggtgttcaggattaaattgtccgcctgtaagcgggacgccatcattcagaaagctgagcagccgctgatagtggcgttcactgacgattttgccgtactgcggattttgttcaggctgagggccgtaaaattcactgatcgcatgcttcatttcttctatgagcttcgttttgatatcttggtggacaactaaataatccggtgcgatgcaggtttgccctgcatttgtaaatttcccgaagacgatgcgtttggcggcaagctgtatatcagcatccttatggacaatgcagggacttttgccgccgagctccaaggtaacgggaattaattgtttggaggcggcctccataacgatttttcccacggcaacgcttcctgtgaagaaaatatagtcaaagggctgctgtaataaaacagtgctgacgtcgggcccgccctccgccatagcgacataatcactcggaaaaacgctgctgataagtttagaaagaacagcggaaaccgcaggcgtatattctgacggtttgagaacgactgtgtttccggccgcaatggctccaatcaagggtgaaagcgccagctgcaagggataattccaaggcgcaatcaccaaaacgattccatatggctcagggataatcatgcttttcgagcccaggtgagtcagaggcgttttgactcgcttcggtttgacccattttctcagccgcttcatcacaaaactgatttcttccagaacaattccgatttctgtcgtgtacgcctcctgttcggatttgtggagatcctgatagagagcggctgctatatcggcttcttgtgttttgatggcttgtttcagcttttgcaatatgttcagccttgattctagcggtctcgtatgccccgccgcaaaataggctttgtgcttgctgacgatagaggggatgctgttcattccgtctctcctttttgtaagtatgatgattcattatgtaaaaaatcgcttctgcctgtcaaatgattaaggtgagtcagaaaaaataacaaactcatttctgcgtttcggcaggaatttgatgaaaaagagaattctttttgcggcattatctgttgcaggcattatggggttttctaatgtacatgtagttgaaaagccggttggcacataaaaaaaagccccggacaggggcttttttaataaagagagggaacagcccaaaagaaaaaccccggaaacattgtcatcacaacatgtccggggtttaatccaatgctctttaaagagcgttttacttaacgggagtagaactcaacgataagcgcttcgttaatttccggagcaagctcagagcgctctggaagacgagtgaatgtaccttcaagcttttcagcgtcgaaagtaaggtactcaggaacgaagttgtttacttctacagattctttgatgatagaaaggtttcttgatttttcgcgaacaccgattgtttgaccaggttttacttggtaagacggaatgtcaacgcggcttccgtcaacaaggatgtgaccgtggttaactaattggcgagcttgacggcgagtgcgtgcaagaccgagcttgtacacaacgttatcaagacgtgcatctaaaagaatcatgaagttttcgccgtgtttaccagtcatttttgccgctttgtcaaacaatgtgcggaattgacgttcgtttacaccgtacatgtgacgaagtttttgcttttcttgcaattgcaaaccgtattctgatagttttttacgctgtcccggaccgtggggacctggtgcgtaagggcgtttttctaattctttacctgtaccgctaagagagattcctaaacggcgggacagtttccaagatggacctgtatagcgagccataatgtgactcctcctttggttttattttgtggaaaataaaaaccgtctgttcgatccgaccgtgcacattttgttttcatgtatcctcgctccagcagcagagagttacacgatacaccttacagctaaggaacaaaatgcaaacacagaagctgaacaaaaaggctgcaatatttcacacaaagaacattatatgatttttccccgccgccgtcaaccatttctccatgaagagtgccggtttatgatataatgtacaaaaatgagtagtacatgtttaggtgataaaaatgaaaaaacaaacaattgatgaagtgacggcctttcatcagaaaatgctttcttttttcttaacgaaatctgaatccgtctcattatccgactcgctgttatggctggcctcagctctagaatcctgctttacatctctttcattgaccctttcaccggcagaatcaacacgtttcaccataaaaacagaagatgaaccgcattatgctccgctgaaagagagtgacggccgttttatgatcaggaatcagacgtccggcagatccttttatctgcgctcggaaggcgggctgccgatcccggaatcattgcctgagatcgttactcagtttatcaatcaatctgtgagacaaagcgggctgtttgacaaaacgaagcatcagcggaaaattcacagaatgacagaaatgttccattcgcttttggatcaaaatgaggttttggaaaaactgcaggcaagtttgagtacggctttccggtctttccgcttttcactgtttatcacgcaggatcaggatacggacagacagcttcccgcaaaagaattacatatggatggaaaagatgccgatccgtctgccctgaaggtttatttatcggggagactgctcagaaaaggcaggtcatctgcttacctgccgatcaaaggccagcaggggacttacggggttctgaagacggaggggctgcaggatgccgttctttcgtgcagtactctcagtgaaatgctgctgcttgcgggcgcggcgggaaaagcatttgaaaatgcgcagctctatgagcaatcgaaaaaaagcattgcgaatctggagctcattaatgaaacatcgcgccagctgaatcagcgcctcagactcactgacacgatgcgggaactcgccgccattatgacccaatcatttcatgcggaagaagtggctttttttcatattgatcattttgagacgcaaaatctgcttccgggacataccgctttttttaagacagaacgtgcgaacccctatatcagcattgtgaaagaaaagctgttcgagggagaaaagggcgtgtttatcggcagcggaaagactgtattcggcgaaaacggcttcggctcgctgatggcggtgccgatgatcgaaaatgacaccgtcttcgggttcgcgattttattgaaaaaggatttgtatgcttttacgtttgaaatgtataagctttttcaagcgctcattcaccatgcgacattggcggtcacgaactccatgctgcgcgacaggcttgagcatcttgttcagacagaccagctgacggagctgtattcaagaacctatttggatgagaaaattcaatacagcatgaaaattcataaacggggtgtattcatcctcgttgatatcgataatttcaaaaccattaatgatacatacggtcatcaaacgggagattcgatcctgattcaggtggcctccgttatgaaaaaccatattcgtgagcatgatgtcgctgcaaggtggggggcgaggagctggctgtctatctgccgaatatcaacgtgtcatccggagaacgcatcgctaaaaggctggttcgcgccatccgggaaaacaccgagccgcgcgtgacgatttcctgcggcgtttcctgctggtcaaagacaggcccgatgccgttgaaaatgctcgttcagcaagcggacgaggcgctttatatcgccaaacggaacggcaaaaaccggctgatcatccaccaaaacagcacgacgacataaaaaaggagccggcctgccggccgggctcctttttttatcctaatcgtttttcaagcgtttcaacaaactttgctaaataggcttcgtccgtttcatcaaaacggtttttcacagggctgtcaatgtccagcacaccgatcacttcaccgtttacgcggatcgggaggacgatttctgactgggaagccgcgtcacaggcgatatgtcccgggaacgcattcacatcggcaatccgctgcacggcgccgttagagtaggcagtgccgcatacgcctctgccgaacgggatgcgcacacaggcaggaagtccttgaaacggtccgagcacgagctcgccctctttagcgaagtaaaaccccgcccagttgacttcatgtaatgaatggtataaaagcgctgatgcattcgcgtaatttgcgatcgcatccgtttcatcttctgtcatggcttcgagctgtttaagcagaagctgataacttttttctttatctccggattgtttttcgacatgaaacatggaaaaccctcactttttctataatatcaaacaaagttccggccgttctgccggcatttgtcgagaagttcttacaggaacggcgcctttctgcttgaattgttacacataaaggggtgagccgtatgaaagtaagcaccaaagacaaaattattaacgccgctgtccagctgtttaaccaaaaaggttattccggcacgtccgtccgtgaaatcgcaaagtcagctgatgttaatgttgcgcacatctcctactattttaaagggaaaggcggattaatggaacatttagtttccgagttttacgaaggctatactgaagcgctggaaaaagccgccgtcagtttgaacggtgaagacgcgcaggaacgcatcctgcgggtgattttcgatattttatcctatcagcacgataaccgtcaactaacgcggtttgtgtaccgggaagtgacgattgattccgtgcttatcagggaaattatgtctacttacttaatgaaagaaaaatatattttccagctggtgattgaagaagggcagtcacgccacagacggctgacgctgcccgtgccgcattttattctgcaattgaaatccctcttgatgatgccgtatcttcagcctcaatacattacagaggtgctctatatgcagcctcatgaaccgtacttttataaaaggtattttgaagaggtgaagatctggatcgaaagcgtgttccgacggcctgatgcggcgcttatgaagtaatgatgcttttgtacgtttcataggaactgccgacatcttccgcttgatgggcgtccgacccgaatatgagcgggatttttttttgcttcgcggtctcagccatccaatcctccatgtatacttccccggcaaacttctttctgagcccggatgtattcacatccagctccattccgtgttctttcacggcgtcaagacagcgggccgcaagctctcttatttgaggtgacatgctgtaagggaaaaggcgtgcgaattttttgacgagcgtgatatggccgacccgttttggcttaaaggggccgagcggtgttacaatggaagaatacacagtttcatagtattgttcatatacggcttcaacgcttccgaagtgcgcggcgagctgctgaaaggcgtgctcgtcaaaatcgaggcagatataagacggaccggtcttcaaaaaatgaacggataaaatgccgtcatccagtgaggggccgtacgtgttcagaaacgccgcggtttcctcttcataccctgtgataaaatcagtttcgagcccggtcagaatgctgatttgtccatcgtattcctttttcagctgtgacagccgctccaaataaacctccatctgtctgagatccatcgcgctgtcctgaagcggtacgggatcttgaaatgacggaggaaggggggcgtgctctgtaaatgtgatcgagtcaaagcctctttccagggccttttcgacatattctttcagcgcatccttcgagccgtgagggcaaaaaggcgtgtggatatgagcgtctcgtttttccatttgtgtcactccattaaaaaattgcagaatcctgccgaaattatgcaaaaagtttttgatttctggtcaaaaaatgttggttacatggtatcataataacaatgaaaacgacagattttctcaatacatatattgaaatctttctgaatacataaaacaccctgacagattaagagaacaacaaggggctcattatggagttagtcatcggattattggttatactgctcgcgctctttgcggcgggctactttttcaggaaaaaaatttatacggaaattgaccggctggagtcatggaagattgaaattttaaaccgttcgatagtggaagaaatgtccaagatcaaacatctgaaaatgaccggagagacggaagagttctttgaaagatggcgcgaagagtgggatgaaattgtcacagcccatctgccgaaagtagaagagctcctttatgatgccgaagagaacgccgacaaataccggtttaaaaaagcgaatcaggtgcttgtccacatcgacgacctcctcactgcagccgaatcaaatatagaaggcatactgcgtgagatcagcgatcttgtgacgagcgaggaaaaaagccgcggagagattgaacaggtgcgtgagcggtattcaaaagcgcgaaaaaaccttctggcgtatagccatctctacggagagctatataacagcctggagacggatctcgacgaaatctggagcggcataaaaaagttcgaagaagagacggaaagcggcaattacatcaaagcgagaaaagtgctgcttgaacaggaccgcagactggatcagcttcaaacatacatagatgacgttccgaaactgctcgctgactgtaaacagaccgtgcctaaccaaattgccaagctgaaagacggctaccgggaaatgacggaaaaaggctacaaattggagcatattcaaatcgaaaaagagctggagacactcaccaatcaattgaaacgggccgaaagcgcgcttttggaagaattagatgtcgacgaagcgtccgccattcttcagctgattgatgaaaccattcaatcgatgtatgaacagctggaaggcgaagtggaagccggacagtccgtattaagcaaaatgcctgagctgatcatcgcgtatgagaagcttgaggaagaaaaagaccgcacaaaaaccgaaacggagctcgtcaaggaaagctatcagctgacggcgggagaaatcggcagacagcatgctttcgaaaaacagctggaaacgatcggccggctccttgagcaggcgagagaaaagcttgacggtgagcatgtcgcttactcgctgctgattgaagaagtcgaggccatcgaaaagcagatggaagaagctcagaaagaacatgccgaataccgtgaaaatctgcaggcgctcagaaaagaagaactgcaggcgcgggaaacgctgatgaatcttcggaaaaccatttctgacacggcccgaatgctgcaaaaaagcaacgtgccgggaattcctgaacaagtcaaggacaagctcgagacggcaaatcatcatatagaagagaccgtcagccaattggaagagctgccgttaaacatggaggaagccgccaaacatctgaccgaagctgaaaaggtggttgcggaagtcagcgaagaggcggaagaacttgtgattcaggtgaagctgattgagcggatcattcagtacggcaaccgtttccgaagccagaatcatattttatccgaacagctgaaagaagcggaacggctgttttacgcttacagctataatgaagcttatgagatggcggcagatgctgttgaaaaagcagctcccggcgccgtgaaaaaaattaaagctgatcaatctgcttcatagacgcacaagcaaaaactgcaccctgatggaaatcagaggtgcagtttttttgtttctcacggaatataaaaagcgcctatggctgatatacatcaaaccgcaggcgctgaatgttacgattttgctttatttaattcgatgggcgggctgataaaaaacgtgatgatgcagccgatgatcgctccggcaatgcccggaagcacccagccgattcccatgctgtaaagcggaagatttgcgtttaagaatgaatctaatgatccgagcggaatgccggctgccttcaaaccgtccaggatactgaacagccccgttccgatcaggcaggcgatatagacttcgcgtctttccttaaagattttatcaataaaggaaagtacgataatgacaatcgccagcgggtaaatggctgataaaataggaactgaaaatgcaataatctcagcaagtccgaaatttgaaatcgccagactgaacagcgtgacaatcgtaaccaccattttgtatgataaagcgggaatcaattttgaaaaatattcgccgcaagatgtgacaagcccgatgcttgtcgttaaacacgcaacggtgatggcggcaccgagaacaatgtttcccagtgaaccgaacaggtaatcagatgaagctgataaaatctttgcgccttcgccgagcggcccgacagcgtccgtgcttgtcgctcccaaataggccaaagataaataaatgaatgtcaaacccgccgctgcaatcagacccgctttaatacaagcggcggcgagcgctttacgctgggtgacgcccctgcttttaacagcgttgacgacaacgacgccgaagacgattgaggcgagcgcatccattgttttatagccttccaaaaatcctttgaacaccggcgttccggaatatgcctgatgtacggcgcccagcccgcccatcggagtgacgatggcttttacgacaatgattaaaataataccgaatttaatgggagtcaaaatctttccgactctgtccacgattttggacgggttaagagctaaataatacgtaatagaaaaaaagatcaacgtgaaaacaaataaagataatctttccggaatgccgcttaaaaacggaactgcaccgatttcatatgaaacggttccggttctcggaatcgcgaaaagcggcccgattgataaataaagcacaacggtgaaaatagtgccgaataccgggtgagccttatcggcaagtcctttcgcgtctttgcccgttaatgcgatggcgataatacctaaaagcggcagtcctacgccggtcagtaagaaaccgcccatcgctttccagacattatgccccgccgcttgcccaagctccggcggatatatcatatttcctgccccgaaaaaagtgcgaagagcatgaaaccgataataacggtatctttgacaggtagtgagtgtttcataaaagtcctcctaaatactatgttgaaatattctgtcaattaattgtcagataatataacaaaacgaacattacttattatatggcaatgtacagagaagtcaatactcgatttattgcgaatttctatttacttttgttatggtagcataaatatcatacgatgtaccgttttcataaaaggagtaaaaaaaatgatatatttagacaacagctcaacgaccgagccgtatgaagaggttttggaagtgtataaacagacgagcagccgttatttcggcaatccttcgtctctgcaccagttaggaactgagacggagcagctccttgaagcggccgctcagcaaataaaaagaaccttacgtttaaaaaattatgatattgtatttacatcaggcgcgactgaagcgaataacgctgcgttaaagggagcggcctgggcaaacatgagtaaaggaagacatatcattgcttcggcgattgagcatccttctgtgacggagacgcttgatcagctgacagagctgttcggctttgaagtcacatatcttccggccgatcaaaacggcttcgtttctttgaaagacgtcaaatcggctatcaggccggatacgataatcgtcagcgtcatgcatgtcaataacgaagtcggctccattcagcccgtaaaggaaatcggcgggtttttgaagcagcaccggaatattctgtttcatgttgatcatgtgcagggcattcataaagttcctctgtctatagaagaagcgggcattgacctttgcactgtttcagggcataagtttcacggcttaaaagggaccggagcgcttatcgtcaaaaaaggaacgcggctcattccgcttataacgggcggctcgcagcaaaaaggcgtccgggccggaacagaacatacggcaggcgccgtttcccttgcgaaagcgatcaatctttccgcgcgtgacatgaatgagcggctttcttccgtggaggctgccaagaatgcgctcatggaaaggctgagcggggcggacggggtcgtcatcaacactcccgccgaaaacagcgctccgcatatcattaatttttccgttccgggcgtgaaggccgaagtgctgctgcacatgcttgaggaaaaaggaatatatgtctccacaaccgcggcatgttcggcaagagagcataaaccgagccgtgttcttctgcaaatgaataaaggcgaacaggttgcatcaagcagcatcagagtcagcctgaacttcatgcatacggctgacatcacggagccgtttatggccgcgctggtgccggctgttcaaaaactaaaaaaaatgatgaggtagcatatgaattacgatcatattttaatccgttttggtgaaatatccacaaaaggaaaaaacagacgcagttttattgaaagattaaaacaaaatatccgcctggtattaaaggattataaaaaagtaaaatacttttcaaaccgggaccggatgtcaattacacttaatggagaaaacccggagggaatttgttccttattaaagaatatattcggcattcaaagtttcagtctcgcaattaaatgcgaaagcaagctggaagacattaaaaaaacggctttagccgcgatagaaggcgaatataaaccggggaatacgtttaaggtcgagaccaaacgggcttacaagcagtttgaattagatacgaatgcgatgaacgctgaaatcggcggccatattttgaaaaacacggatggattaaccgtcgatgtgaaaaatcccgatattccgcttcggattgaaatcagggaggaagcgacattcctgaccattcgtaacgaaaaaggcgccggaggccttcctgtcggttccgcgggtaaagcgatgctgatgctttccggcggttttgacagtccggtcgccggtttttacgcgatgaaacggggattatcagttgaagccgtacatttcttcagtccgccgtatacgagcgaacgggcaaagcagaaagtcatggatctcgcgggatgcctcgcgaagttcggcggcagtatgacgcttcatatcgtgccgtttacaaagacgcaggaactcatccaaaaacaaatcccggaaaactatacgatgacggcgacgcggcgtcttatgctgcaaatcgcggacagaatcagagaagaacgaaaagcgctcgcgatcattacgggggaaagcctcgggcaggtagcgagccagacgcttgaaagcatgtatgcgatcaatgccgtgacggcaacaccggttttgcgccctttaatcggaatggacaaaacagaaatcatcgagaaatcaaaagaaatcggcacttatgaaacaagcattcagccgtttgaggattgctgcaccatctttacgccgccaagtccgaaaacgcgtccgaaaaaagaaaaaatcgagcacttcgaaagcttcgttgattttgaaccgctgattgcagaggccgctgccggcatcgaaaccatcactgtttactcagagcaggaagctcacgataagtttgccggcctgttttaaaactgtatacaattaccaaagtttttttgaatgaagacatgtgttttatcacattctatactcacaaggaggtgatacacatgtcacaacaatcaaacagcggaaacagcaaccagcttttagtgccaggcgctgctcaagctatcgaccaaatgaagtatgaaatcgcttctgaattcggtgtaaaccttggaccggaaacaacttctcgcgccaacggttctgtcggtggagaaatcacaaaacgtcttgtctcttttgctcagcaaagcatgggcggaagcagccagcagcagttttaatcacaacttcacataatggctaagagagcggggaattccccgctcttttttcatgagtatagatagaaggctggaagcaatttatgcatatttttattgtaatggcctatgtttatgtataatggggaaagaaagtgaggagttgttcgtgttaaaacgagaagatttaatcgccccaaagaactataatcttgtaaatgaaatcgaaaagttcagccgttccaaagagaagaacgcgcttatttgggaagatcaaacaggcggcaagaaagtctggacgtatgaaaaattgatggaagaaacgaataaaatcggagcccgcctgaaaggtctcggatttgaaaaaggcgataagctgattgtcatggttccgagagtgcttgaagcgtatgccgtttatttagcgatcttaaaagcggggatggtcgtcattccttgctcggaaatgctgcgcgccaaagaccttgaataccggatcaaacacgccgaagtgaaaggcgctatcgtttatccttcatttataaacgcatttgacgaggtgaataccgagcagctggtgacattgtcaatcggtgaaaatgatgccggctggaaaaacctcttaacgattgaagcggacggaaacagttttcaaacagctgatacaacaagagaggacatggcgtttttgtcctatacttcaggcacgaccggccagcctaaaggcgttgtacatacacacggctgggcctttgcccatttaaaaacatcagccggtgcatggctggatatttccgaagacgatacagtgtgggccaccgcggcgcccggttggcagaaatgggtgtggagcccgctgctcgccgttctgggaagcggcgcgacaggattcatttatcacggcagattcaacgccaagacgtatttagagctgctggagcgccatcaagtaaatgtcttctgctgtaccccgacggaataccgcctgatggcaaaagtggaggagttggacaaatatgatctttctgcccttcacagcgcagtttctgcgggtgagccattaaaccgggaagtcattgacgtattccggaagcatttcggtattaaagtgagagacggatacggccaaacggagagcaccctgttagtcggcgtcctgaaggatatggatattaagccgggaagcatgggcaaaccgacccccggaaatcaagtagagattataaacgataagggcgaaatatgcgaaacaggcgaaacgggcgatatcgccgtgcatttgagcacaccggccttattcaaggaatattataaagatcccgaaagaacgaaaaagcagattcgcggagattattttcttacaggagaccgcgcgaaaaaagacgaggacggctacttttggtttgagagccgcaatgatgacattatcgtcagctccggatatacaatcggaccttttgaagtagaggacgcgctcgtgaagcatccggaagtgaaagaatgtgcagtcgtggcaagcccggatgaaatcagaggttcaatcgtaaaagcttatgtcgttttacaagacgatgaaaagcggagtgacgaacttgtcaaagaactgcaaaaccacgtaaaaacgattacggcgccttacaaatatccgagagagattgaatttgtcgaaagcctgccgaaaacggcgtccgcaaaaatcagacgtgtggaactgagacagcgtgaagaacggctgaaggctgataaaaaagcataatacaggataaagggtgagcggggatgaaagcgatttggcacggcggcaccatctatacaatgcttgacaagaatcatgtcactgaatccgtttataccgaagaaggcgtcgtcaggaagacgggcagctatcgggagctccaaggaacatacggttcgcctgatacggaggaaatcgatttacatggagctgtcatgttcccggggtttacggacagtcatatgcatttaatcggacacggggaaaaacagcttcgcctcgatttgtcgcagctgacgtcaaaagaagcgatcctgcgggccgcaaaagaagcagagcgtgaattggaagatggcgaatggctgatcggcgaaggctgggatgaaaacctgtttgaacggccggattacgtcacgaagcatgaccttgacccgctctttcccgaccgccccgtcctgctgaagcgggtatgccggcacgccgttgcggttaattcggccgcattgcgcgcggcggggattacaaacgaaacatctgatccaaacggcgggattatcgtccgggacggcaccggtccgacaggccttctgctggataaagcccaagagcttgtgacacaggccctgccgcccgtctcacttcactatgtcaaacgcgcgcttcaaacggcgattacggactgctggtcaaaaggcctgacaggcgggcattcagaagatctggcatactacggagacgcgtccgttcccgttgccgcgtacgagtctttaaccggcagcggcctttatccttttcgcgcccatctgctcgttcatcacgaagccgtcgacagctggagcgctctggataaatcgaccggaccttacctggaatacggagcgatgaaaatttttgctgacggcgcgctcggaggcagaaccgctctgttgaaaaagccttatcatgatgatccgtcagtttccggcgttcaggtgcacgatgacgagacccttgccgctcttgtttataaagcgagagagaaagggatggagatcgccgtgcacgcgattggcgaccttgcatttgaaaaggtgctcgatgttatcgaaagatacccggcaaagcccggacagctagacaggctcattcatgcgcaagtattagatgccggattgattgaaagagccgcccggctgccgatcggacttgatcttcagccgcattttgtggccagtgattttccgtgggtgattgaccggctcggagaagagcggatgaaaacggctttcgcctggaaaacactgctgtcaaaagggctgctgtgcgccggaggctcagacgccccgattgagccggccgatccgcttctgggcattcaatcggctgtgctccgtacaagcaagcagcatccggaaggtccggcctattatgaaaaagagtgcctgaccgtgtacgaagccattcagctttacacggagggaagcgcggccatcatccataaagaacatagccgcggacggatcgcccccggctatgatgccgactttaccgtactcagcggtgatccgttcgggacggatccgaaaaagcttcatgaattggaagctgtcaaaaccgtcgtcggcggccgtatcgtatatgaaaaagaggacaggcagtgatgcccgtcctctttttttatgataaaaatgatcgctttactttttcccagaaagagttgtctttcagtttcaccgttttgatttttttatcggatagtgtaatctcaacctttttgacattccgcgtgctgagcgcttcattatcaagcccgataatcggatgctcattgccgtcctggaccacctgcagtgtcagcttccggtctgagcttaaaataaacggagatccgagtgtacggtatgtgttgttgttcaacgacgccagttcggatacctgcatgcaggaaatcaaaggatcaacaacggcgcctgaaacagatttattgtaggcggtgctgcccgtcggggtggaaatgatcatcccgtctcctctgaacgtctcaaaatgaagatcatcaattaacacatccatcacaaacgttttaataatgcttgaacggatggaaacctcgtttaaacagtgaaaatgattgctgccgtccaccgttacatgaatgagcgggtattttctgacctcaagctgttccgcggtcatgctggccgccattttttcaggctcatcgctgtgaaaatcacagtacaaatgggctttcccttttttagcgatgccgacatacaggcagtcatcacggaatccggtttttctgacggcttgcagaaatgagccgtcgctgccgatgctggcgataattccggcatcctccgggtgagccgcaactgtaaaaccgtgcgattcagcaagctgcttcaaagagctgacttgttcttttgtttcgttgttttgtttgtgaaaaaaataaacattgcggcgaagatcggtcatatccccattcccctttgctgtcatatttacgtttttctcccagcaggtattgtgttaaaatacctgtggcaatagtgtaacatgtttcctgtttatccgttaagagaaagcgcttcatgaaaaaaatgaatctttttttacgggggaacgtacgaatattgacagaaaaggaggagaacaaatgaatgcaaaaagatggattgcgctcgtcatcgcgctcggcattttcggcgtatcggtcattgcaagtgtgaccgtcggggtgctgaagaatatcggagatacagggtctgactttgcatcactgacagatgacacagaggaagtgacgctggataagggcagccccggcagtaaaatcgccgtgcttgaagtggacggcacgattgaggataacggcgggtccgctggcctgctcagctcaggcgggtatgatcacagatcatttttaaaacaggttgagcgtgcgaaagaagataaaagcgtcaaaggaattgtactgaaaatcaattccccgggcggaggcgtgtacgaaagcgcggaaatacataaaaaactggaagaactaaagaaagaaacgaagaaaccgatttatgtgtccatgggctccatggcggcatcgggaggctactatatttcaacggccgccgataaaatctatgcttcaccggaaacgctcacgggttcactgggcgtcatcatggaaagcgtcaattattccaagctcgccgatgaactcggcatcaagtttgaaaccattaaaagcggcgcgcataaagacatcatgtccccgacccgcgacatgacgaaggaagaaagaaagatcatgcagacaatggtcaacgattcttatgaaggatttgtcaatgtcatttcaaaaggccggcacatgtcaaaagcggatgtgaaaaaaattgccgacggccgtgtttacgacggcagacaagcgaaaaaaatcggcctcgttgatgagctcggtttttacgatgatacgatcagcgcgatgaaaaaggaccataaaaatatgaaaaacgcttcagtcatcacatacgaggaaggattcggattaggctcgctcttttccatgagcgcagcgaaaatgtttaaaagcgaaattgattttctgaatatgaaagaactcatttcgcaatccggttcgccgcggatgatgtatctctatgcaaagtaggggggaagaaagaatggacgcgacttacgaaggctttcacggcaaagaagaggaagccgaacaacagagggcgcccgagcaggcatatgcgggcttttggatcaggttttgggcgtttcttcttgattggctggtggtctggggacttaaccatctcatcgtttcaccgattttcacgctgatgaagctcccggcaacaagcggaatgtttacaatctcagcttattccgtcacaaccctgatcgtctacctcgcctattttgtgttcatgacgaaatggtttcatcagacactcggcaagatggtcttcgggttaaaggtcacttctttgacgcccggaaagccgctgacttggagcaccgtcattttcagagaagcggtggggcgttatatcgataaaatctggattctctatatcgtcattgcgtttacgcccaaaaagcagggcattcacgatctgatcgccgacacaacggtgattcacgaagcgctgtaccgcaaataaaagcagtaaacccggaataaacgtccgggtttattttttttggttttggcgataatgctgctaaggaagtgaagcctatgggatatgccgcagcagctgttattctcattctcattttggtctggctgctcatgaggatgaaaatccatctgactttcgaatatcttcacgataaagataacgacaaactgacgtttaaactctcggccttatacgggctggtccgttttaaaaaaacgctgcccgtcattaaagtaaacagcgaagacgcgtctattgatgtcaaacaggacacgaaatcagaaatgaaaggtcagaaaaaagagaagaaaaaaatcacatatgaagatgtcaaacagagcattcacagaatagaaatgattctgcaccaagtcttgcagatgcgccaaatcgccgcctcatttcttgcgggagtccgtgttacgaagtttgaatgggtgacggttatcggaataaaggacgccgccgttacgggaatcgccgccggcggattgtgggccgtaaagggaggccttacggcgatgctgtatgatcatctgcgtttcatacataaaccggtgtgcgaagtcattccgtcttttcaagtgcctgcatccaagacgcatttgcagtgtatattcttttttcgttttggacatcttataggtgcagctttcaaattgctcaaatacgggcggaacggactttctatcatacgaaagaaacagccggttccggttgcttcaaagaatgattcatcagtttaaggaggagcgcatatggcagaccaccccattcaaggtttaatgaaaaccgctatggaaaatttaaaagaaatgattgacgtgaatacaatcatcggcgatcctgttgaaacgcctgacggcagcgtaatcttaacggtttcaaaggtcggattcggatttgcggcgggcggaagcgagtttggaggaaagccggctgaaaaaagaaccgatgatgatgaaagaaaagagcagaaactcccgttcggcggcggaagcggcggcggagtatccattacgccgattgcgtttctgattgtcggaacaaacggcgtgcgtatgcttcatttagacgaaaacacccatctgattgataaactgttagactccgcgcctcaaacgattgaacgcatccagcatatgtttaaaaagaatgaaaaaggccggaaccaaaaaagaacggatatcgatttataacagaaaagttaactgccgcccgcagttagctttttttacgatgcggcataacctttgcagtttgcataaaactcgactatgatagagctatacatagataaagggaggaatcagaatggctgaaattacatttaaaggcggagccgtgacgctgatcggacaagaagtgaaaccgggtgaccaagctcctgacttcacggttttgacaaacggattagaagagaagacattagcagatatgaaagggaaagtaacgatcatatccgttattccttccattgacacaggcgtatgtgacgcgcagacacgccgcttcaacgaagaagccgcaaaactcggtgatgtgaacgtttatacaatcagcgccgaccttccgtttgcacaagcgcgctggtgcggagcgaacggaattgataaagtggaaacattatcggatcataaagagatgtcatttggtgaagcattcggtgtttacatcaaagaacttcgtcttttggcgcgttccgtattcgtccttgatcaggacggaaaagtcgtttacgcggaatacgtaagcgaagcgacaaaccacccgaattatgaaaagcctatcgaagctgcaaaagcgttaatcaagtaaagagagaaaaagagctccgggtgctgccgcggagctcttttcatggcaaggaggaaacagcatgcaacacgatcatgtcggtcagatttatgaacttttagatgaagccgcccaagtgatagcagaaggccttgagatttcttatattgaggggcttgcggaggcgggagagatgtattttcttgaaacaacggaccagcttccgcttcaggaaaaacaaaccggcgagcttaaaagcctgcttgcgaaagcagacttcagaaaatgggagcatgaatggatccgcaaggcgttccagctcgccattttaaaaggactgaaagataagtcccatccgaacagacagatgacgcctgatacgatcggccttttcatcagttacctcgtgaataaatttacgggcggccgaaaaggcctgacgttgctggaccccgcctgcggcaccggaaatcttctgctgaccgcggcaaaccagctttctgacaaagcgggaaaaagcttcggcattgaaatcgacgatgtccttctgaagatcgcatatgcgcaggcgaatctgcaggaaaaagaaatggagctgttctgccaggacagtcttcagccgttatttatcgaaccggccgatgcggttatctgcgatttgccggtcggctactatcccaatgacgaaggcgctgaagcgtttgagctgaaagcggatgaaggccactcatttgcccaccacttatttattgagcagagcgtcaaacatacaaaaccgggcggatacttattttttatgattccgaaccatctgtttgacagcgcgcaaagcgataaactgaagcggttttttgcggaaaaagtatatatcaacgccctgcttcagctgccggctactatgtttaaagatgaagcgcaggcaaagagcattttaatcctgcagaaaaaaggcgaagacgcaaagccgccgaaacaagcgcttttggcgaatcttccttcttttgcgaaccagcaggcgatgcgggagatgatggcaaaattggatcagtggattcaaaaagaaaaataatggcgaaaaagcagtgtgagacgcaaaattccgcgctgcttttcgctttttaaaatgaatggaaatcagggcgaaaacacaaattaaggaaagaaaataacattccgtaaggccgtgccgtccatttggcacaaatgagatttatcagaaaatatcgacttcgtattgtaagcggtaccaatgtggatgttgacttgaaatgctgagttgacaatgtttaaatggaaaagtcagatattttttggaccgcagttatggtctgggaaaaaagaacgaacaaacgaagaagaattttgataggagcgtcatttatgtctaaaattattgcaattaacgcaggaagctcatctttaaaatttcagttattcgaaatgccttcagaaaaggtgctaacaaaaggtttagtagaacggatcggtatcgccgacagcgttttcactatctctgttaacggcgaaaaaaatacagaagtgacagatattccggatcatgcggttgcggtgaagatgctgcttcacaagctgactgaattcggtattataaaggatttaaacgaaattgacggaatcggccaccgtgtggttcacggcggagaaaaattcagcgattctgttttgcttacggatgaaacaatccgtgagattgaagagatttcagaacttgcgccgcttcataacccggctaacatcgtcggcattaaagcctttaaagaagtgcttccggatgtgcctgcggttgcagtgtttgatacggcgttccaccaaacgatgcctgagcaatcttacctgtacagccttccgtacgaatactacgagaaatacggcatccgcaaatacggtttccacggcacttctcataaatacgtgacacagcgcgcagctgagcttctcggccgcccgcttgaagatttgcgtctgatttcctgccacctcggtaacggcgcaagtatcgcggccgtagaaggcggaaaatccattgatacgtcaatgggcttcacaccgcttgcgggtgttgcgatgggaacacgttcaggaaacatcgaccctgcattgatcccgtacattatggaaaaaacggatcagacggcagatgaagtattaaatacattaaataaaaagagcggactgcttggcatatccggtttctcaagcgacctccgcgatatcgtagaagcttcaaaagaaggaaacgaaagagcggaaacggctcttgaagtgtttgcgagcagaatccataaatacatcggttcttacgctgcgagaatgagcggcgttgacgcgattattttcactgcgggtatcggtgaaaacagcgttgaagtcagagaacgcgtgcttcgcggcttagaattcatgggtgtatattgggatcctgcgctgaacaacgtgcgcggcgaggaagcgtttatcagctaccctcactctcctgtcaaagtcatcatcattccgactgacgaagaggtcatgatcgcacgtgacgttgtccgtcttgcacagtaatgatcgaaaaaagcacatcctttagggtgtgcttttttattgaatgccccagaatcaaacgttacgatatgtttaatacataaacgatgaggtgaagcaatgagtgtgcatgaacataaacaagaagccccgtcagccgtgcgctgcaaggtgataacagtcagcgacacgagaacgaaagaaaccgacaaaagcgggcgcgtcatgatggatttcatcagagaagcgggatttgaaacggtcgcttatgacattgtaaaagatgaaaaagatgaattgcagaaagccgttttatccggctgtatggatgaatatacagatgcggtgctgttaaacggagggacgggcattgccgaaagggatgtcacaattgaagcggtcacgccgctgttttcaaaagaactcccggggttcggcgagctgttccgcatgctgagctatacggaggacatcggctccgccgccattttgtccagagcggcagcgggtgtgatccgaaataccgcagtcttctgcacgcccggctcctcaggcgccgtaaagcttgcaatgagtaaactgattattcctgaactgcctcatgtgctccgggaaatccgaaaagatttataaatgtataaaaaggctctgctccgctcaaaaaattgggtggggttttttttataaaaggcttgaaaaaacagaatttacttgttacagtgtatacatacaaaatgcatttttattaattaaaactaatttttatacaaagggagcttttaacatggcagaacaaaaaaaggttgtattggcatactcaggaggtcttgatacttctgtagcgataaaatggctgcaagaacagggatacgatgttgttgcctgctgcttagatgttggggaaggaaaggatttggcattcgttcagcaaaaagcgctggaagttggcgccgtaaattcctatgtgattgatgcgaaagaagaattcgcccgggagtacgcgctcatttctatgcaggcccatacaatgtatgaaggcaagtatccactcgtatctgcactatcccgtccgttaatcgcgaaaaaactcgtggaagtggcggaaaaggaaaacgcggtggccgtagcgcacggctgcacgggaaaaggaaacgatcaggttcgtttcgaagtatccattaaatcattaaatcctgatctggaggtcattgctccggtccgtgagtggcaatggtcgcgtgaagaagaaattgaatacgccgcaagccgcggcataccgattccgatcaatcttgacagcccgtattccatcgaccagaacctatggggacgcgccaatgaatgcggtatattagaagatccgtgggcggcgccgcctgaaggggcatatgacctgacagcatctcttgaaaacacgccggacgttccggaaatcatcgaaatcgcatttgaagccggtgttccggtttcaatcgacggcgtaacctacccgctcgctgatttaattctcaagctgaacgagactgccggaaaacacggcatcggccggattgaccatgtggaaaaccgcctggtcggcattaagtcccgtgaagtttatgagtgcccgggcgccatgactttgattacggctcacaaagagcttgaggatctgactttagtgaaagaagtggcccatttcaaaccggcaattgaacaaaaactgtctgaaatcatctataacggtttatggttctcgccgttaaaagacgcgctgcttgcattcctgaaagaaacccaaaagcatgtcaccggcgttgtgcgcgtcaagctgtttaaaggccatgccattgtagaaggacgtaagtcggaatattctctctacgacgaaaaacttgcgacatatacaaaagacgatgcgtttgaccatcacgcggcaatcggtttcattgagctttgggggctgccgacaaaagtaaacagcattgtgaaaaagaaggagcagattgaagcatgaagaagctttggggaggccgttttcaaaaaacaccggaaaagtgggtcgatgagttcggcgcatccatcacattcgaccaaaacttagtcaaagaggatattacagggtctctcgctcatgcggcaatgctgaaaaaatgcggcattctgacggaagaagaagaaggtgccatccgtcaagggctgcagactctcctgcaaaaagcagaggaaggagcgcttgaattctctgttgattatgaagatattcatttgaacattgaaaaaatgctgattgaagaaatcggaccgctaggcggcaaactccataccggaagaagccggaacgaccaggtggcgactgacatgcatctatatttgaaagatcatgtctcgcatatcatcgtgctgattgaacagttccaaaaagcgctgatcgaaaaagcggaggccaatgtcgagaccattctgccggggtacactcatttgcagcgggcccagccgatttctttcgcccaccatctgcttgcttatttttggatgcttgaacgggataaagagcgttttcgggatgctatgaagcggattaacatatcgccgctcggatgcggggcgcttgccggaactacgtttccgatagaccgtaactattcggcggagctgctcggttttgactccatttacgagaacagtcttgacggagtcagtgacagagattttattctcgagtttttaagcggcagcagcatgctgatgatgcacctttcacgtttgtcagaagaaatcattctatggtgctcgcaggaattcagattcattgaactggatgatacgtacgcgacgggaagcagcatgatgccgcagaagaaaaaccccgacatggcggagctgatccgcggtaaaaccggacgcgtatacggtgatatgatgggtcttttcacaattatgaaaggactcccgctcgcttacaacaaagacctgcaggaggataaagaaggcatgtttgacacagtaaaaaccgttgaaggaagccttcagattttcacgggcatgattgaaacgatgaaagtaaacaaagacatcatgaaacaagcgacaaaacaagatttttcaaacgcgacggaacttgccgattatttagctaaaaaaggcatgccgttcagagaagcgcatgaagtggtcggcaagcttgtgtacagctgtattgaaaaaggaatctatttaagtgacatggcatttgaagaattccttcaagccagcagtctctttgaagaagatatctataccgtgctcgatccgcatcatgcggttgaaaaaagaatgagcgccggcggaacgggttttcagcaggtagaacaggcgctcgtaaaagcaaaagcctgcgccggcatttaatttgctgaaatttccttcatattttcccgtcatatcagacaccctacatctataaaagatgggaggtaaaaggaatgcgcaaagaacaagaccgttacatctatgatgaaaaagaaagtgaagaaacggccaggcttatctcagaggcataccaaagcggttatgtcggcatggaggaagcctctgctccttcagaaaattaagctgtctgtaaagacggcttttttttcgtgcggacgaagtgcaaaaaagtgatattgccgtttgtttatagtaaagtagagggagaaacgtcttgattttattgaagcggctacgttgcctggggagggtattcaatgtgcgacatgctctaatcactgccggtacaaagggattgggccgaaaagtgactgaaatgcttctggaaaaaggcttttctgtcacagtgaattacagacaggacgaagaagcggtcgcttgtctgaaggcggattatcccgggtgccatgacagattgcaattcgttaagggcgatgtaacccggaaagaagatctcatgcggatcgccgatgcagcccttcagcggtttggaaggattgacatactgattaacaatgccgggccgtacatatttgagcgcaaaaagcttgccgattactccgatgacgaatggtatggcatgcttgaagggaatttaagcgccgttttccatctgtttaaagcggttatcccggtcatgagacagcagcgcttcggccggattattacatacggttttcaaggagcggaccatgcccccggctggcttcaccgttccgctttcggagcggctaaagtcggattggcttcgttaacgaaaaccattgcgattgaagaagccgaatcaggcattacagccaatatggtctgcccgggtgatattgtaggagatatgaaagaagcgtctatagaggaagcaagacggaaaatcggcaaagaaaagacgccgatcggcaggtccggaaccggagaggatattgcgagaatcatcgcgtttttatgtgaagaagattccgatcttgtaaccggaacggtcattgaagcaacaggcgggctgaatgtgattaacaggcatcaatccctgtaagttttttcgtttgtcaaaaagggaacttgataaatattaattttttatgaggtgaaaacgatgaaagtgacttatcacggacattctgtcattcaagtggaaacgaaaacccataacattatttttgatccgtttctgaccggaaacagtctgacaaatttgaaaccggaagaagtgaaagcggatgtcatcctgcttactcacggacacaatgaccatgtcggagatacagagcagatcgccaaacaaaacgatgcgctcgtcattgcgccgaacgagctggccgtttatctcggctttaaaggtttaaaggtccacccgatgcatatcggcggggcgcaccaatttgatttcggcaaagtaaaactgacacaggcgttccacggatcggcggtcactgatgaagaaaacaaaaccatcacatacaccgggatgccggccgggattttattaacgattgacggcaaaacgattttccacgccggcgatacggcgctgttctcagatatgaaactgatcggggaactgaatcacattgacctggcgtttctgccgatcggtgataacttcaccatggggcctgaagatgcgaaactcgcggctgaatggctgagagcgaaacaggtcgttcccgttcattacaatacattccccgtcattgaacaggaccctgacgctttcgctgaaagtctgcccggaggcgtcggcaaagtcatggcggtcggcgagaccattgagcttgcctgacatatgtgtcaaagaccttctgaatcaagcattcagaaggtcttttttgtggtgccgccttttttcgggcgtctcattgcgaatgaatcccccgtacccttataataaaagcagaagactgtccttagaggtgaaacgcttggcaacaaagcatgaacaaatcctatcatacatagattcgcttcctgtcggtgaaaaaatttcggtcagaagaattgcgaaagaaatgaaagtcagtgaaggaacggcttacagagccattaaggaagccgaaaacaaaggattcgtttccactattgaacgtgtgggaccatccggattgaacagaagaaaaaagaaaatattgaaaagctgacatacgctgaggtcgtcaatgtgatcgacggccaggtgctcggcggaaaagcaggtctgcataaaacgttgaataagtttgtgatcggggcgatggagcttgacgcgatgatgcgttatacggcggcggggaacctgttaatcgtcgggaaccgaatcaacgcccaccgccaggcgcttgaagcgggcgcggccgttttggtaacaggagggtttaataccgacgacagcattatcgagctggccgatatgcttgagcttccgattctctccacgagctacgatacctttacggtagccgcgatgatcaaccgggcgatctatgatcagctcataaaaaaagagattgtgctcgtggaagatattttgacgcccgcagatcggacagtgacgctgttccctaaggataaactggagaaatggtacgaaaagaactatgaaaccggacacggccgctttccggttatcgatcagcagatgaaaatccacggaatcctcacgccgaaagatatcgcggggcatgaccggtcagttcccattgaaaaagtaatgaccaaaaaccctgtcacggtgatcggaaaaacatctgtcgcctcagcggctcaaatgatggtttgggaaggaattgaagtgcttccggtgacagacgggcatcacaaactgatcggaatgatcagccgccaggatgtcttaaaagcgcttcaaatggttcaaaagcagcctcaggtcggggaaaagctggatgatattgtttcaaggggatttaaagaagaggaagataacaaaacgccggccgtttatcaatatgaagtcacgccgcaaatgaccaatcagctcggcacgatttcttacggggtgtttacaacgattttaacccaggccgccagccgatttttacgctcccgcaaacgcggcgagctggtcattgaaagcattacgattttcttcctgaagcccgtacagatggagtcggtcatagaagtgaaaccgcgcattttagaggcgggccggaaattcgggaaaatggaagtggaagtgtcaagccaaagcggcatcgtttcaaaagcgatgctcatggtgcagctgatggagagaagttaagggacacacccgggtcccttggcattcattatgcgtggtccctctccgcttcctttgcatggatgggctcataatgcttataggctttatacccggcccatgcgctgcctgctccgattaaaatgaagacgccgccgatgaccagggtcaggacggagtggaacagaatcatttggtttactccgtacaaaagcaccagcgcgcctaatgccatacttgatttagccgaaaaacattccttctccagcgcccgtttcgtctggattccttttactttgtaatacacgtaaaagcaggcagaaagcccgatgagaaaaacaaaaaccagcataaatgaaatcctccattatatgagtttgcaaaaccgtttataccgttgctgaaagattttccttttccatggataaagagtatgattaaatgaataaaaacgaaaaggagaaaacgatgaaatccgaactgatcagaaccatatcattatatgacaccattatcttacatagacatgtgaggcctgacccggatgcctacggttcacagtgcggccttacagaaatcctgcgggaaacgtatcccgaaaaaaatatttttgccgtcggacagcctgaaccgtccttgtcttttttatattccctcgatgaggtggatgacgaaacctataaagatgctcttgtcatcgtgtgcgacaccgcaaaccaaggcagggtcgacgatcagcgctaccattccggcgcaaagctcatgaaaatagaccaccatccaaatgaagatccgtatggcgatctgttatgggtcgatacgaatgcaagctccgtaagcgaaatgatctatgagctgtacctggaaggaaagcagcacggctggaaactgaatacgaaagcagctgagctgatctacgctggtatcgtcggtgatacggggcgcttcttattcccgaacaccacaaaaaagacattaaaatacgcgggagagctcattgagttcccattttcatcgtcagagctgttcaatcaattgtatgaaacaaaattaaatgtggtgaagcttaacggctttatttatcaaaatgtgtcactgtctgaaaacggcgtcgcttccgttttcattaaaaaagacattttggagacatatggaaccaccgcttctgaagcgtcgcagcttgtcggaacactcggaaatatttcgggtatccgcgcttgggtgtttttcgtagaagaagacgatcaaatcagagtccggttccgttcaaaaggtccggtcatcaacggaattgcccggaaatacaatggcggcggacatccgcttgcggccggcgcatccatcttcagctgggatgaaaccgatcagattcttgctgatctggaagaggtatgtaacgaacacaagtagaggggagaccctctttcttagtgttcatctgtcacggggatgaaccagcagccgaattcagtcaggtcttcgtagacgcggagattacagatttggagttctttttttatgagggaagcgagtgtgtctgtttctgcatatgcggaatagccttgtctgattcgggctgcatgatcttttgccaagcggcgttcactaaaaacctccattttcccttcctcccttcagaatcgttgaaaatgtctcatctacagtttataaaaaagcggagaaaaaagcgacagatctatggaaaatttttaaaaataacataattacgtcgcaaaagaaatatgaatttcgacagacaatctcgtataaatcgtcagttcctttacttcagctttaaattccttctcatttatggtgtatattttgttttcaattgtccgttttaaaagctcctttgttttatacacgctttcaatatcctttgtgatgacttcagaaatattatctttcacctgttcctcaaatttcatcttgtcaggctgggcgattctgtatttttcccaattaatcagcttcacatcaacactttggatgagaagtctttgcttattatcctcatttaatttatgaagatctttctgatagatggagatttggttttttaaatcccgcgcgtgctcccgctgcttttcaattaacgtcacctgttcttcctgaaacgttccgtatgtaaacagaaagaacagccagctgatgatggctccgcacatcattcccgcaaaaaaacgctgccatcccggttttttataatactcgggaattctcatgatgacatattctcctgggtcagccatgaaataatcagccagccggtctgcgcgccgcccattgctgaaataattaaaagaagctgtttgaagatgtcgcgcgtgttgccttcaaacagcccccgctcgaaactgtataccgcgtcaaatgttcccccgatggccgcgacaagcgcccagatcttcagcctgttcgccaattttgtgatcgccgtcagcggaggctcgcctgataaataagctccgaggccgccgatcagcgcgccgccgagcaacacaccgagggcgataaaataactgctgatgaaattcgccataaagccggcttcctgatccatatatacaccacctcacttttctatcatattgagcgaaacggacaagtatgatgatgagtcaaaaaagaacatttgtttcttaagaaaacccgtcttataatgtagaaagacaaaatgaacgtatgggaaaggagtggcggcattgtcttttgttcacctgcaagtacatagcggctacagcctgttaaacagcgccgcttctgtaaaagagcttgttacacaagcgaaggaactcggatattcatcattggcgctgacggacgaaaatgtgatgtacggcgccattgagttttataaagcatgcaaatcaaacggaattaagccgattatcggtctgacggcttctatatacacggacgatacggagcttgaagcacacccgctcattcttttagcggagacaaacaccggttatcagaacctggtgaaaatctcaagtgcgctgcaatccatggcaaagggcggcatgaagcgaaaatggatgaagagctatcatgaggggctgatcgccattacgcccggtgaaaacgggtacattgaaagcctgcttcaagccgggaagtttgaagaagcggtccgggctgccgaaggattccgggagctgttcggagacggccgtttttatttagggtaccagccgtttaaaggacatgagacgttatcagaagagattctccgcctgtcagccgagacggaaatcgctgtctgcgctgcgggagatgtccgctatatcaagaaagaagatcaagatgcgtaccgctgtctgtgcgctattaaagccggagagaaatgggaggatcagagcgggaatctgccggacttatacttgaggacgcctgaagaaatggcagagctttacacgcggcatccggaagcgattgaagcggccgcccgtatcgcccggcaatgccgggtcgatgtaagcctcggacagacacagcttccgtcttttccggcgccggacggcaaatcagccgatgactatttggcggagatctgtcatgaggggctgcgtctccgtttcggcactcctgatgagcgggctgtccgccggcttgaatatgagctggacgtcatcaggcgcatgaaattcagtgattattttctcatcgtatgggactttatgaagtacgcgcatgaaaagggcattgtgacaggcccgggaagggggtccgcggcaggctcgcttgtcgcttactcgcttttcattaccgacgtggatccgcttaaacattctctgctgtttgagagatttcttaatcccgagcggatcagcatgccggatattgatatcgatttccctgatacgagaagggatgaggtcattcagtatgtacaaaataagtacggggccatgcacgtcgcccagattatcaccttcgggacattggccgcaaaggcggcgttaagggataccgggagagtgttcggaatcagcccgaaagaagccgaccagcttgcccgcctgatcccgtcgaaaccgggaatgacgcttgaggaggcgaggcggcagtccgctcagctgaacaggcggctgtccgaatccgccgttcttcataaagtgtttcagatcgcaaggaaaatcgaaggtcttccgagacacacgtcaacacacgcggccggggtcgttctcagtaaagagccgctttcggaagttgtccctcttcaagaagggcatgacggcgtgtatttaacgcagtatgcgatggatcacctggaagatctcggtcttttgaaaatggactttttaggtttgcgcaacctgacgcttattgaatccattaaaacgatgattgaaaaagagacgaatacgaaaattgatttttccgagatttcttatcaggatgaaaaaacgttctcgctattgtcaaacggtgatacgacgggtattttccagctggaatcatcaggaatgagaaacgtgctgaagcgcctgaagccgtcaagactggaagacattgtcgcggttaacgcgctttacaggccgggaccgatggaaaatattccgttatttatcgatcggaagcacggacgggcgcgtgtggaagtgccgcacgaggacgtaagaaatattctcagtgacacttacggcgtcatcgtctatcaagaacagataatgatgatcgcctcgcgcatggcagggttttcattaggtgaagcggatctgctcagacgggctgtcagcaaaaagcaaaaggacattctggacagagagcgaagccattttgttgaagggtgcttaaaaaaggagtattctgtagtcactgcaaacgaggtctacgatctgattgtaaaattcgctaactacggattcaacagaagccatgctgtcgcatacagcatgatcggctatcagctcgcctatttaaaggcgcattatccgctatattttatgtgcgggctgttgacgagcgtcatcggcaatgaggacaaaatatcgcaatatctgcatgaagcgaaggggagcgggattcaagtccttccgccgtcaataaacaaaagcggttttccgtttgcgccggaaaacggagccgtcagatacagtttgcgggccgttaaaaacgtaggcgtctcggcagtgaaagatatttataaagcaagaacacataaaccgttcgaggatcttttcgatttctgctttcgcgtacctgcaaaaagcgtgaatcggaaaaccatcgaagcccttatattttctggcgccatggacgaattcaatcaaaatcgcgccgccttgctggcctccgttgatgtggctttagagcacgctgaactttttcgtgcagacgatgaccaaatgggattgtttttggaagaatcgttttccattaagccaaaatatgtagaggctgaggaatttccgctcgtggacaagcttcggttcgaaaaagaagctctcggtgtttatttctcaagccatcctttgtctgctttcagggatctcctgaaaaaacggggggcgcaaacgatcacagcagcgcggcagatgccgaagggacagctgtcaatcggcgctttgctcgcgggcattaaaacgattcggacaaagacaggtcagcatatggcgtttctcacattaagcgatgaaacgggagaaatggaagccgtcgtgtttcctgaccaatatagaaggctgtctccgctgttaaaagaaggcgcgcttttattcgccgccggaaaaatggaagagcgtcaggagaagacacaattcatcatgtcatccgcctctcttcttgaacagacggaggcagacagagcgccgtctgtttacatcaaaatcgaaggcagccggcacaatcaggagtttttggaaaagatgaagcgtattttactggagcataaaggggaaaccggcgtttatctatattatgaaaaagacaagcagacgatcaggctgccggatacttttcatattgaggcggaccatcaggcgttataccgtttaaaagagctgctgggccgcgaaaacgtcgtgttaaaatagtggtaacaataatcgttttgttatacaattgaaacaattgtgctatcttatttaaagattctgaaatttttcacctccagcgattgtaccagtctatgcggcagaatatgtaacaaagtacttaaaaggagtgtttagaatgtcattaagagaagaagcgttacatttacacaaagtaaatcaaggaaagctggaatcaaaagcaaaggtagaagtcagaaacgcggacgacttaagccttgcctactctcccggagtagctgagccttgtaaagagatttatgacgataaaaataaagtatatgattatacaatgaaggggaacatggtagcagtcgtaacagacggatcagccgttctcggtctcggtaatatcgggcctgaagcttcacttccggtcatggaagggaaagcggtgctgtttaaaagtttcgcgggcgtggatgcattcccgatcgcgcttgacacaaacgatgtggacaaaatcattgacactgtgaagctgcttgaaccgacattcggaggtgtcaaccttgaagatattgcggcgccgaactgcttcattatcgaagagcgcctgaaaaaagaaacaaacattccggttttccacgatgatcagcacggcactgccatcgtaaccgttgccggacttgtaaacgcgctgaaattatcaggaaaatccatgtcatccattaaagttgtggcaaacggagcgggagcggcaggcatcgcgatcattaagcttctttaccatttcggcgtacgcgacatcgtgatgtgcgactctaaaggagcgatttacgaagggcgtccggccggcatgaacgcggtgaaaaacgaagtggccaagtttacaaaccaagaccgcaacgatggctcgctgcaggatgtcattaaagatgcagacgtctttatcggcgtatcagtcgaaggcgcgctgacgaaagaaatggtggagagcatggcgaaagatccgattatcttcgcaatggccaacccgaatccggaaatcatgcctgaagacgcgcgcgcagccggcgctagcgtaatcggaacaggccgttctgatttcccgaaccaggttaacaacgtgctggcattccctggaattttccgcggggcgcttgacgttcgcgcgactcacatcaacgaagaaatgaaaattgctgcggttgaagcgattgcttcccttgtttcagaggaagaattaagcgctgattatgtcatcccggctccgtttgacaaacgcgtggctcctgccgttgcgaaagctgttgcgaaagcagcgatggaaacgggcgtcgccagaattacggtcgatcctgaagaagtggctgaaaaaacaagacagctcacagtcatcggggaataataacacaaaaatgaaatggcagcgcgttggaaaaaacaacgcgctgctgttcaatatacggactgctggcatttttttaagggcaggtcttaaaaaaatttcagcagaatccttatttcttttgaaaacgctgacagataaggctgaacaacgctttttacggtatgaaatccgtccgtttccgtctgttttgcagcaaaaaatgtcgaatggaggatgacaccgtttgacaaaaaaagtacaatagtttcggtaaagttattattaagtctatctaatcggaagacatgcagtgaagagaacccttcacaaaagggaggtaatcatttgttaaaggatatattcacaaaaaagaaaaaatatgcttccgtgccgtctgagcaggcaaaacatgatgttccggaaggcattatgacaaagtgccccaaatgtaaaaaaatcatgctcacaaaagagttagataaaaacctgcgcgtctgcatgaactgcgggcaccatttcccgatgaatgcaaagcagcgcattgaaagcctcctggatgaagattcattcgaagaattcaaccagggaatgatatctgaaaacccgctcggtttcccggaatacttagaaaaaatcgaaaaagaccgtgagaaaacatcgctgaatgaagcggtggttaccggaaaaggaaccatcagcggattccctgccgtgatcgcgatcatggattcaacattccgaatgggcagcatgggttcggttgtcggcgaaaaaatcacgcttgcaattgaaaaagcaaaagaggaaaaagtcccgtttatcatctttaccgcttccggcggcgcacgtatgcaggaaggggtcttaagtcttatgcaaatggcaaagacaagctctgcattaaaactgttcagtgaggagcagggactgattatttctgtcatgacccacccgacgacaggcggcgtatcggccagtttcgcgtctctcggtgattataatttcgctgaaccgggcgccttgatcggatttgcaggaagacgtattattgaacagacgatcggggaaaaactgccggaagatttccagacggcggaatttttattaaagcacggccagcttgatgcggtgattcaccgaaacgacatgaaagagaaactcgcatttctgctggacatgcaccaaacaggaggtgagcatgagtggctgcaagattagaatttgaaaaaccggtgattgaactgcagacgaaaattgccgaactgaaaaaattcacccaagattcggagatggatttaagcgctgaaatcgcaaggcttgaagaccggctcagcaagctccaggatgagatttataaaaatctgaagccgtgggacagagtgcagatcgcacgccttcccgaccggccgacgacgcttgattacattcaatacctgtttaccgacttttttgagtgtcacggagacagaacatacggagatgatgctgcgattgtcggcggagtcgccaaatatcacggcatgccggtcaccgtcatcggacatcagcgcggaaaagacacgaaagaaaaccttgtccgcaatttcgggatgcctcaccctgagggctaccgcaaagcgcttcgtctcatgaagcaggcggataagttcaaccgcccgattatctgcttcatcgacacgaaaggagcgtacccgggtaaagcggcggaggaacggggacaaagtgaagccatcgccaagaacctgttcgagatggccggcctgacagtgcctgtcgtttgtatcgtcatcggggaaggcggcagcggaggcgcgcttgcgttaggtgtgggcaaccgcatgctgatgcttgagaactcgacgtattccgttatttctcctgaaggagccgcgtccattttgtggaaagactccagccttgcgaaaaaagcggccgaaaccatgaagattactgcgcccgatttattagaattaggaattattgatgatatgattaaagaagtgaagggcggagctcaccatgatatcaagcagcaggcgggctacattgacggtattcttaaagaaacgttaaaatctcttcttcgattgaacgccgaagagttgatctcacagcgctatgaaaaatataaagcaatcgggaaagtttcggttgaggatcaatatatcggggtaaactgaatagacgtgaagcctatggctcacgtttattttttgtgatttttgtgatattccttaaattttatttaaaaacaatttatttaattgtataataggtaaggtttcatgggagctcaggcgtcccttttcattgttttagggcaatgatcatgatatgtttaacatatatagttgctgaggtgaataggaaatgaagcgtataggagttttaacgagcggcggggattccccgggtatgaacgctgcggtgcgcgcggttgtgcggaaagctatctaccacgacgtcgaagtgtacggaatttataacggttattcaggattaatcagcggaaaaatagaaaaactggagctgggttcggtcggtgacatcatccaccgcggcggaacaaagctgtatacggccagatgtcctgaattcaaaacagttgaaggccgtgaaaaaggaatcgaaaatttaaagaaactcggcattgaaggtcttgtcgtcatcggcggagacggttcatacatgggtgcgaaaaaattaacggaacacgggtttccgtgtgtaggtgtaccgggtacgatagataatgacatcccgggaactgattttacgatcggatttgatacggcgttaaacaccgtaattgatgcgattgataaaatccgtgacaccgctacgtctcatgagcgtacatacgttattgaagtgatggggcgccatgcgggcgacattgctttatgggcaggtcttgcaggcggagcggaatcaatcttaattcctgaagcggactacgatatggaggaaattatcggccgtttgaagagagggcacgaccgcggcaaaaaacacagtatcatcatcgttgcagaaggggtaggcagcggggttgaattcggaaaacgcatcgaagaagaaacgaaccttgaaacacgggtatccgttttagggcacatccagcgcggcggatctccaagcgcttctgaccgggttcttgcaagccgcctcggcgcttacgcggttgagcttctgcttaaaggaaaaggcggacgctgcgtaggtatacaaaacaacaagcttgtagaccatgatattatagaaattttagaatcaaaacatactgttgaaccaaacatgtatcagctttcaaaagaactgtctatttaaggcggaagaagctgaagatttcagaaggaagtgaacgagttgaaaaaaacaaaaatcgtttgtacaatcggtccggccagtgaaagtgtagaaatgctgacaaaattgatggaagcgggtatgaacgttgctcgtctgaatttttcacacggtgatttcgaagagcacggcgcaagaatcaaaaacatcagagaagccagcaaaaagctcggcaaaaacgtggggattctcctcgatacgaaaggtccggaaatccgcacgcacgatatggaaaacggcgcgcttgagcttcaggcgggaaatgaaattatcgtttctacgaaacaggtgctgggaacgcttgaaaaattctcagtttcttatgaaggcctggcagacgacgtgtcagcagggtctatcatcctgctggatgacggtttaatcggattggaagtgctggaatcaaatccggaaaaacacgaaatcaaaacaaaaatcttaaacagcggcacgctgaaaaataaaaaaggcgtaaacgttcccggcgtcagcgtcaaccttcccggaattactgaaaaagacgccaaagacatcatattcggtatcgagcaaggcgttgatttcatcgctgcgtcatttgtacgccgttctacggatgtcctggaaatccgcgaactgcttgaagagcataacgcgtctgacattcaaatcattcctaagatcgagaaccaggaaggcgtggacaacctggatgcgatcctggaagtatctgacggcctaatggtagcgcgcggagacctcggcgtagagattccggccgaagaagtgccgctcgtgcaaaaagaaatgatcaaaaaatgcaacgcgctgggcaaaccggttattactgcgacacaaatgctagacagcatgcagcgcaaccctcgtccgacacgtgctgaagcaagtgacgttgccaacgccattttcgacggcacagatgcgatcatgctttccggtgagacggctgcgggacaatatcctgttgaggcggttcaaacaatgtttaacatcgccacacgcacggaagaatctctgaactataaagaaattctgtctaaacgcagagatcaggtcggcatgacgattactgatgcgatcggccaatcagttgcgcacacggcgatcaatctgagtgcggcagctatcgtgacgcctacagaaagcggccatacggcgcgtatgatcgcgaaataccgtccgcaggctccgattgtagccgttacggttaatgagtctgtatcacgcaaactcggccttgtattcggtgtattcccgtcaagcggccaaaacgcgaattctacagatgaaatgcttgaagacgcggttcaaaaatcacttgacagcggcatcgtgaaacgcggtgatctgattgtcattacagcaggttctgtcggtgaatcaggcacgacgaatctgatgaaagtccacactgtcggcagcattatcgcgaaagggcaaggcatcggacgcaaatctgcattcggtccggtcgttgttgcaaaaaatgcgaaagaagctgaacaaaaaatgacagacggcgcagtattggttgcttcaagcactgaccgcgacatgatcgcttcacttgaaaaagcatcagcgctcatcactgaagaaggcggtctgacaagccatgcagccgttgtcggtttaagcttgggcattccggttatcgtcggccttgagaacgcaacttcagttttaacagaaggacaggttatcacagttgacgctgcccgcggcgctgtgtatgaaggccgcgcaagcgttctttaaacagctttaaaaaagagaggggggttctcccttctcttttgtctttaggttgattttcctattcccatgcgggcggtgacgcgcttttagaagggcaggagggcagaaaaatgagagtgttattcttactgtttatcgtatgtccggcaattgaaatcggtttgtttctgctggcgggaaaatggctcggtatttttccgaccttccttctcatcattttgacaggcgtgttaggcgctttggtggcaaaaagacagggaaccgatgtgtatcatcgggtgatgcgcgacctgcagcacggcaaaatgccgggggaagcgcttcttgacggaatatgcgtctttttcggaggcctgcttttgatgcttccgggttttctgtccgatattgcaggggcctgtcttctgattccgttcactcggaaccgcatgaagccgtttttgttcaaatggctgagagggatgtcaaaaaacaagcggatcattatcaaataaaaaacggcagccttcttacagggctgctgtttttatttggattgaacagtaatataggcccatatttcttttagagcgcccgttgtgataaaggcctgaatgaaaacgagcagcgcgggcccggcagccagtcctaaaattccgaacaatttaaagccggcaaacagggcgattaaggtcgcaagcggatcaagtccgattgacttgcttaaaattttcggctccgtcagctggcgctgaatgagaaccacaatatataaaacaccgagaccgatcgcttgaggaagctgaccggcaatggccaaatacataatccagggaacaaagaccgacccggcgccgagatacgggagcagatcaaccaggccgataaaaaaggcgatggttgccgcatgctcaatccctaaaagaaaaagtccgataaagacaatgatcatcgtgaaaagtatgagcacggcctgcgccttaatgaaacctgccatcgcttttttcagctctcccgatacggccttggcgtttgccgaaacccgttccggaaaaatggaataaagcagcgccttcagcttatgccagtcctttgtcataaaaaaagtcgccagcattgcgaaaatgaagacggcagctgtattgggaaggaaggcaatccatttcggcaccagctccaaaagatgtgaaagcatgagccccgcatttttagcggctgtatcaccgagggtctgaatatgcgtcacgatggaagcctgctgattggtttccagcccgttaaataggacggtcagctcgtggtacaatggctgaatgcgggaagtgaacagctcttcgcaatacgtcataaaggcgctgatatggggagggagcgttttggccagataggcggttcccgaaatgatttccgcaacgagaaatgttgccgcgccgagaagaataagcaaaaagaagaccaggacaatgactgtattgactgaccggggcagccccgtcagtttgtccagccagtcaacaacgggaatgatcgctgatgacagaataagggcgatcagaaacggataagttaacggaaatgaggcgtaaccggccgctaaagcgccgccggccgcagcgagtacaaacagcgcgcggaaaaaaacagttgcatagtgcggattcacatcgatcctcctctcggtcggcacgtcctattacattagtttattcgtcaaaaaaaaggatatgattacagatatgatgaaagagggtgctttcaggatgtttacacaggcgaatttatttttactattattgctggccatcgcattggtagccaaaaatcagtcattgctttttgccgtcggctttctcattgtgataaaagctgtcggtcttgatcagaaactatttccggttattcagtcaaaaggcatcaactggggggtcaccgtcattacaatcgccgttttagtgccgattgccacaggtgatatcggttttaaacagctcggagaagcgatgaaatcatattatgcgtggatcgctctcggtgccgggatcgcggttgccttaatcgccaaaaacggtctcaccttattggaaaacgaccctcatattacaacggcgctggtcatcggcacgatacttgccgtcgcgcttttcggaggcgtcgccgtcggcccgttaatcggcgccggaatcgcctacttggccatgcaaatcgttaaaatattcacttcataaagtaaaaaagcggcgtaaagctgcttttttttgcgggtgaaaataagagtttgcagggcattttgtagttcagacaaatgccatttgcattattccgaggaatgaagtggcttaccatgtaacaaagaacttcggaatcgccggcgcatattgtgcgatgacagcggatgcagtaaggcggttccaattgatgaatggattaaaagctgatggaatttatgcacttgaaccaaatcaaaacttgaagtgttgttaaaataagcggagaccctttccttcaatttgaaagtttgttaaatttataatgagaatgaaaaaacacaattcggttggtagtccggatgcattatttaaaatgtcagtaaccttcccctcctcgggatgtccatcattcttcagtaaatttaggaggagggaatcgttatgaaattaacggtttactacgatggtcagttttgggtaggagtcattgaagttgtgaatgatgggaaattaagagcagttcgtcatttgtttggaaaagagcccaaggattcagaaatcatgcattttgttcataatcaacttttacagactctctcccgcactgaacaaacaggggtttgtgttaaagcaaaatctaagaagttaaacccaaaaagattacaacggcaagcttctaaagagatgaaaaatatcgggatatcaactaaggcgcaaaaagcgataaaacaggagcttgaagcaagaaaagaaaagaaaaaacaactgaacagaaaacaaagagaaaaaataaaggaacaaaaatatttaatcagaaaacaaaaagcaaaagaaaagcataggggcaaatagttggagaacccgaagcccttcgattaaaaagttgagcggcatcagttttttcttcggactgatttagaaaaaagaagcagaaatcgagcccttctcgagatgaggagggtttttctgcatttatttaacttcacctacatcagtaaatgagtcagtttcaattgatgaacggtttgatgaggatatttacgggccgacaacagcgcaaatgcagtcaaacgattccagtccatgtacggggagccaactaaaaccaagacatggatttccgaagctgatccgaacattgattcagtcgagtaaacaaaatccccccttctccggtaaagaaggagggatttgcggtgaagttgttgcgcctgtccttttaaagtttccccaaagctccccccaaatgaaaacatgagaatacatggttttacaaagcatctgaaagcaagcgattaaatttatcaacgccaagccttgatatatagggcttttaaaacatttttagttaaaagtctacaaattaatcagattattgtttataataagaataggcttaaacttaaataagcttataagaatttgttatgttcctctataagcataccggttatgtaaccgcaaccagtgaaatgtaagcattttcttaaaggggaaagggattgtttgcatgactcattttaagtaagccgtatgttttatatactctttaaaggggaattttgattgaaaaggagaggttgaatatgacagcaacacgcggtcttgaaggggttgtagcaacaacatcatctgtaagctctattatcgacgatacccttacatatgtagggtacgatattgacgacttgacagagaatgcaagttttgaagaaatcatttatttgctgtggcatctgcgcctgccgaataaaacggaacttgctgaactgaaaaaacagcttgcgaaagaagctgccgttccacaagaaatcattgagcacttcaaatcctatcccctcaataacgtacatccaatggctgcgctccggacggcgatttcattactcggtctgactgacagtgaagccgatgtcatgaatccggaagcgaactacagaaaagccatccgtctgcaggcgaaagtgccgggcattgtcgccgctttctcaagaatccgcaaaggacttgatcctgttgaaccgaaggaagagtacggaatcgcggagaacttcctttacaccttaaacggtgaagagccttctccgatcgaagtggaagcgtttaacaaagcgctcattcttcatgcggatcatgagctgaatgcatcaacatttacggcgagagtatgtgtcgccaccttatctgatatttactcaggcatcactgccgcaatcggcgctttaaaaggaccgcttcacggcggagccaatgaagccgtcatgaaaatgctgacagaaatcggcgaagtggaaaacgccgagccttatatccgcagcaaaatggagaaaaaggaaaaagtaatgggcttcggacaccgtgtgtataagcatggagacccgcgcgccaaacacttaaaagaaatgagcaaacgcctgacgaatctgacgggtgaaagcaaatggtacgagatgtcaatccgtgtcgaagaaatcgtgacgtcggagaaaaaacttccgcctaacgttgatttctattccgcatctgtctaccacagtctcggcattgatcacgatctgttcacgccgatctttgcggtcagcagaatgtcaggatggatcgcccatattcttgaacaatacgataacaaccgcctcatccgcccgcgcgctgattacacgggtccggataagcagacttttgttccgcttgatgaaagagcctgatcaaacgggaggctggtgattttcatgtcgttagcctcttgttaatcaagcccggattggtttacaattttgatagaatcttgagaaaagtcattttattttttatacaagaaaaataaaatgttttctaaatatgaattacatactgggaggtaatattgtgtcacaaggtgaaaaaattacagtctctaatggagtattaaacgtaccaaataatccgattatcccgtttattgaaggcgacggcacaggccctgatatttggaatgccgcttctaaagtattggaagccgctgttgaaaaagcatataaaggcgagaaaaaaatcacgtggaaagaagtttatgccggtgaaaaggcttataataaaacaggtgagtggcttcctgccgaaacactggaagacatcagagagtacttcatcgccatcaaaggtcctctgacgacgccggtcggcggcggtatccgttctctgaacgtggcgctgagacaggagcttgatttgtttacgtgcctgcgccctgtcagatatttcacgggagtgccttctccggtcaaacgtcctgaagatacggatatggtcattttccgcgagaatacggaagatatttacgccggaattgagtatgcgaaaggttctgaagaagttgaaaagctgatcagcttcctgcaaaatgaaatgggcgttaacaaaatccgtttccctgaaacgtcaggaatcgggatcaagcctgtttctgaagaaggcacaagccgcttagtcagagctgccattgagtatgcgatcgaaaacggccgtaagtctgtcacgcttgtccacaaaggaaacattatgaagttcactgaaggggcatttaaaaactggggctacgagcttgccgaaagagaatacggagataaagtattcacttgggctgaatatgaccgcattgtcgaaaaagacggaaaagaagcggctgataaagcgcagagcgaagcggaagcggcaggaaaaatcatcgtcaaagacagcatcgctgatattttccttcagcagatcttgacccgtccgagcgaattcgacgtcgtggcgacaatgaacttaaacggagactatatctctgatgcgcttgccgctcaggtaggcggaatcggaatcgcgccgggagcgaacatcaactatgaaacagggcatgcgattttcgaagcgactcacggaacggctcctaaatatgccggccttgacaaggtcaacccgtcatccgtcatcctttcaggagtgcttcttcttgaacacctgaactggaatgaggctgctgacttgatcattaaatctatggaaaaaacgattgcttcaaaagtagtaacgtacgattttgctagattaatggacggtgcaactgaagtgaaatgttcagagttcggtgaagagctcatcaaaaacatggactgaacctaaagcagacttctaatgaagccaaaaaaggagaagagaatcatgggaaaaacacgcagtaaagtttctgttatcggagcaggatttacgggagcgacaacagcctttcttacagctcaaaaagagcttgcggacgttgtgctcgttgatattccgcaattagaaaacccgacaaaaggaaaagcgctagacatgctcgaagcaagtccggttcaaggatttgacgcgaaaatcacaggcacgtccaactacgaggacacagccggttctgatatcgtcgtcatcacagccggaattgcgagaaaaccaggcatgagccgtgatgatctcgtatctacaaacgaaaaaatcatgagaagcgtcacacgtgagatcgtgaaatattctcctgactgcattatcgttgtattgacaaaccctgttgatgcgatgacatatgcggtgtacaaagaatcaggcttcccgaaagaacgcgtcatcggacaatccggagtgcttgacactgcgcgattcagaacattcgtcgctgaagaattaaacctgtctgtaaaagatgtgaccggttttgttcttggcggacacggtgacgacatggttcctctcgtccgttattcctatgcgggcggcattccgcttgaaacgcttatcccgaaagaccgtcttgatgcgattgtagaacgcacaagaaaaggcggcggggaaatcgtcaaccttctcggaaacggaagcgcctactacgcgcctgctgcatcactgactgaaatggtagaagccattttgaaagatcagcgccgcgtgcttccgaccatcgcttacttagaaggcgaatacggtcatgaaggcatttacttaggcgtaccgacgattatcggaggaaacggcctggagcaaatcatcgagcttgaactgacagactatgaaaaagcgcagctgagtaaatcagttgaatctgtcaaaaacgtgatgaaagtattgtcataagaaaaaagggaaggcttccgaatcagaagccttcctctttttacaattaatgaaagcgttttctttttccctgagcgatcctttctctgaaaatgatcaaaaaggcgaattgtctgaacgggcagtattggataaaatgaaatcataaagtgatatgcagcacataaaatagagaaaattggatgtcggggaaaatagacagcggagggcgcagcatgaacaaaaaaattttagttgtagatgatgaacaatctatcgttactcttttacagtataatctggaacggtccggctatgatgtcataaccgcatcagacggcgaagaggctctggagctggcagagaatgaaaatccggatttaatcgtactggatgtcatgctgccgaaagtggacggaatcgacgtctgtaaacagctcagacagcagaaaatgatggttccgatcttgatgctgacagcaaaagatgaggaatttgataaggtgctgggactggagctcggagcggatgattacatgacaaagccgttcagtccgcgggaagtcactgcgcgggtgaaagccattttaagaagggctgacatttcttcgctgtcacaaggcagagaagaggaaaaggacgggcagatcctcatcggcgagctgaaaattcttccggagcattacgaagcgtacttcaagtcagaacagctggaattgacgcctaaagaatttgaactgcttctgtatttgggaaaacacaagggaagagtgctgacgagagatcttctgctgagcgcggtctggaactatgattttgccggggatacccggattgttgacgttcatatcagccatctgcgcgacaaaatcgaatcaaataccaaaaaacccatctatattaaaacaatcagaggtttggggtataaactggaggagccaaaaatgaatgaataaagtccgtgtgcgtctgttcgctttactcgttgtatgtatcatattggttttcagtgttctcggcctttttttacagcagcttatttcttcatccgctgaagaaagaacggcggatcagctgaaaaaggaatcggtatacatagcgggccttcttgacaccggccgaatcggcaataaaagcaatgaaacggtaatccgtgacgccggccgcaccctcggtataaacgtctccttgctcaacgagaagggtgacgccgtatatcattccggcagtcgtgctgatgattcagccgtaaaggagttcatttctcacaataaaagcgaggaagccgtacagtcgaaaagcagagtcatccgcggcactgccgtaaaaaatgacgcagggaaaattgcggggtatgtactcgtttcctcggatatcaacggcggttcaagcgttaccggagaaatgtggggcatgctggcagcaagtctttgtaccgcttttatcattatcgttttcttttatacaaacatgacgtcgcgttacaaaaaatcaatcgacgccgcgacaaaggtggcgacggagctgtccaaagggaattacgacgcccgctcctacagcggttacgcaaggcggtcggaccgtctcgggcgtgcgatgaacagcctggcggtcgatttaatggaaatgacaagaacgcaggatatgcagcgcgatcgtctgttaaccgtcattgaaaatatcggatccggtttgattttaatagacgggagaggttttatcaatctcgtgaaccggtcatacacgaagcagtttcatacaaagcctgaacgtctgcttcggcgcctttaccacgatgcgtttgaacatgaggagatcattcggcttgtcgaagacatttttatgacggagacgaaaaaatgccagctgctcagacttcccatcaacattgagcggcgctactttgaagttgacggcgttccgatcatgggccctgatgatgaatggaagggcatcgtcctcgtttttcacgatatgacggaaattaaaaaattggagcagatgagaaaggacttcgtcgccaatgtctcccatgaactgaaaacaccgatcacctcgattaaaggatttacggaaacactgttagacggagcgatgaaagacgaaaaggcgctttcagactttctgtctatcattctgaaagaaagtgagcggctccaatctctcgtgcaggatttattggatttatccaagatggagcagcaaaactttacgatgcgcgtagagtcctttgatgctgcaaaaattctgcatgaaattgaggcgcttttgcagcataaggctgaggaaaaaggcatcagctttcagctcgatctcccggaagagccgatttttgtgacgggtgatgcgcacaggctgaagcaggtatttttgaatctggcgaacaatgccctgacctacacgcctgaaaaagggacggtggggatttcggtacatgtgaaagaaaccgttgtcgatatcaaagtgtccgatacgggaatcggcattcagaaagaagagatcccgcggatatttgagagattctaccgcgtggataaagacagaagccgcaactcgggaggaaccggcctcggcctcgccattgtgaagcacttaatagaagcccatgaaggtaaaatcgaggtcacaagcgagcctggacagggaactgtgttcactgtgacgctgaagcggccgccggcagcgtgatcagctttacaaaggattaacaatttcttcatgacctgttaaacctatcttgttaggatataacagaaccccttcatccaaggagccaattttgacggcgggaacgcgttttcttgttcccgtccttttttgcgttttcacggggtccgctcattttcctttcaaattgaactttgttaaaataagagaagctgtgagattaaaaaacagaggaatgacgagcttttgctcttaggaggatattgaatgacggaacgaaaaaaattagtgcttgtcgacggaaacagtctggcgtaccgggcgttttttgcattgccgcttttaagcaatgaaaaaggcattcatacaaatgccgtatacgggtttgcgatgattttaatgaaaatgctggaagatgaaaaaccgacccatatgctggtggcttttgatgcgggaaaaaccactttccgccacagcacgtttaaagaatataaaggcggaagacaaaaaacgccgccggagctttcagaacagatgccgttcatccgcgagctcctcgatgcctacaacatcagccgctacgagcttcctgaatatgaagcggacgatattatcggcacgcttgccgtatctgctgaaaaagacggctttgaagtgaaggtcgtttcgggggacaaggacttaacccagcttgcaaccgggaaaacgaccgttgccattacgagaaaaggcattaccgacgtagaagattacacgccggagcacgtgcgggaaaagtacggtctgactcctttgcaaatcattgatatgaagggattaatgggagattcatccgataacataccgggcgtccccggcgtcggagaaaaaaccgcgattaagctcttaaagcagttccattcggttgagaaactgcttgattccattgatgaagtcagcggaaaaaaattaaaagaaaagcttgaagaatataaggaacaagccctgatgagcaaagagctggcgacgattatgacaaatgcgccgattgaagtcaagcccgaagatttagattaccaagggtttgaccgtgaacaagttgttgccatttttaaagacctcggttttaatacgcttcttgagcggctcggtgaagaaagcggggaaacggcggaagaaaattttgaagacatcaatgtcgaaacagcagaagaaatcaccgaagatatgctcgtttcgccgtccgctttggtcgtcgaacaaatcggtgataactatcacgaagaaccgatcctcggcttttccatcgtgaatgaaacaggtctttattatattccgaaagaaatcgccattcagtctgaagcttttaaatcttgggctgaagatgaatcgatgaaaaagtgggtgttcgacagcaaacgttccgtcgtcgctttgcgctggcagggaattgagctgaagggaacggaatttgacgcgcttcttgctgcctacattataaacccgggcaattcgtacgacgatgtcgcgagcgtagcgaaagaatacgggctgaatatcgtttcaaaagatgaagcggtatacggaaaaggcgcaaaacgcgccgttcccgctgaaaaagagcttgccgatcatctcgcgcggaaagcgtctgccgttaacagcctccgtgacaaactgcttgacgctttggaagaaaataatcagcttgagctttatgaagatcttgaactcccgcttgcgctaattctcggagaaatggaatcaatgggcgtcaaagtggatgtggaaagactgaagcgaatgggagaagagctcaaggcaaaactgaaagaatatgaagaaaaaatccatgacatcgccggtgagccgtttaacatcaattcaccaaaacagctcggcgtcattctgtttgaaaaactcggcctgccgccagtaaagaaaacaaaaacaggctattccacttcagctgatgtgcttgagaagctcgcagacaaacatgatatcgtcgcgtacattctgcaatacagacaaatcggcaaactccaatcgacttatattgaagggctgctgaaagtcacgcgcaagggttctcataaggtgcatacacgattcaatcaggcattgactcaaaccggacgcctcagctcaacggatccgaacctgcagaatattccgatccggctggaggaagggcggaaaatccgtcaggctttcgtaccgtccgaaccggactggcttattttcgccgccgattattcacaaattgaattaagggtgcttgcgcatatttcaaaagatgaaaatctgatcgaagcgtttacgaatgatatggacattcacacaaaaaccgccatggacgtgtttcatgtcagtgaagatgaagtgacacaagcgatgcgccgccaggcaaaggccgtcaatttcggcatcgtttacggcatcagtgattacgggctgtcgcaaaacctcggcatcacccggaaagaagcgggcgcttttattgaccgctatttggagagcttcccgggcgtcaaggcgtatatggaagaatcggtgcaggaagcgaaacaaaaaggatatgtgacgacacttatgcagcgccgccgctatatccctgagctgaccagccgcaacttcaacctgcggagctttgcggaacggacggccatgaatacgccgattcagggaagcgccgccgatattattaaaaaagccatgattgacatggcagctgagctgaaagaaaaaaacctgaaggcgcgactgttgcttcaggtgcacgatgaattaatttttgaagcgcctaaggaagaaattgaaatattagagaagctggttcctgaagtgatggagcatgctttggcattagacgtgccgctgaaggcggattatgcttcagggccgtcttggtacgatgcaaaataaacagaaaaaaaggaagtgatgattgtgccggaattaccagaagttgaaacggtccggcgcactctgaccggtcttgtgaaggggaaaacgattgaatcggcggatatcagatggccgaatatcatcaaaaaacccgccgagccggaggaattcgcgcggcagattgcaggagaaacgatccgatccatcggaagaaggggaaagtttttgcttttccatttggatcattatgtcatggtgtcacacctgcgtatggaggggaaatacggtcttcatcaggccgatgagcctgacgataaacatgtgcacgtcgtgtttcacatgacggacggaacacagctccgctaccgggatgtccggaaattcggcacgatgcatttgtttgcgccgggagaggaacggaatgcattaccgctttcacagctcgggcccgaacccgatgatgaagcatttaccgccgcttatttaaaagagcggcttgcaaaaacgaaccgcgcggtaaaaaccgccctgctcgaccaaaaagcggtcgtcggcctcggcaatatttatgtcgatgaagctttattccgggcgcgtattcatcctgaaacaaaagcgaacagtctgtcggacgggcagataaaaacgcttcatacagaaattaaagacacccttcaggaagcgattgacgcgggcgggagcaccgtccggtcttatatcaattctcaaggggagatcggaatgtttcagctcaaacattacgtctacggcaaaaaggatgaaccgtgcaaaacgtgcggcacgatgatttctaaaatcgtggtcggcgggaggggcactcatttttgcgcccgctgccaaaaaaaatcataaactgaagctgttcaagcaggcggcagcagaatgacttttttctaacacagttgatgacctttctccatatatatattgtgattcacccaataggcatatgtcacaattgccgatcaagagaaagggagaaacggatatggagattgtttctttgctgcttttggcttttgctgtcagcttggacagtttttcagtcgggtttacgtacggtttgagaaaaatgaaaatcccgttcaaagcgattgccgtgatcgcctgctgttcagcctctgtgatgtttatatccatgctgatcggccattttctgacaaagatttttcctgtatccgtcacggagaaactgggcgggctgatcttaatcggaataggggcatgggtcatctggcaattttttaaaccggctaaagagccggattacttattgcatgaaaaaacgctgcttaatcttgaagtgaaatcgctcggcatcgtcattcatattttgaaaaaaccgaccagcgccgatattgatcaatccggaaccattaacggagtcgaggcgcttctgctcggtatcgccttatccattgacgcgtttggcgccgggctgggagcggccattctcggcttttctccggttatgatgagcgtgactgtcggggtgatgagctcgctgtttgtttcactcggcataaacgcggggcatttgctttcaaggtggaattggatagataaaatgacatttttgccgggagtcctgctgattatcatcgggatttggaaaatgtaagaaggagtgggctttttgagcttggtcatcggtttaacgggaggcatcgcaagcggcaaaagcacggtagcgcgtatgctgatcgacaaaaaaataacagtcattgatgcggatgtcatcgcgaaacaggcggtggaaaaaggaatgccggcttacggacaaattgtggaagcattcggaaaagacatcctgctggaaaatggcgatattgacagaaaaaaactcggttctatcgttttcactgacgaacagaagcgtctgaagctgaatcagatcgttcatccggcagtgcgtgcggaaatgctgaaacagcgggatgaagccattgcgagaaaagagcagttcgtcgttttggatataccgcttttgtatgaaagcgggcttgattatcttgtcggcaaagtgctcgtcgtcaccgtaccggcagacattcagctcaaacggctgatggagcggaattccctgacagaagaagaagcgatgagccggataacgtcgcaaatgcctttagcggacaaagcaaaaaaagctgacgccgtcattgataacagcggcagtcttgaatatacaaagcaccagcttgaggaagtattgagcggctgggcataaacaaacaccgttcggaaagccgaacggtgtttttctggttaaaaatcaaaattgtcagggtccggaccgacacggagattttcgttcagatcatcaatccgcttcatatcttcagctgacagttcgaaatcaaagacatttgcattttcttcaatacggtgttttttagttgatttcggaatggtgatgacaccgttttgcaaatcccagcgcaaaatcacttgagcggctgatttgccgtatttctcagcaatctcctgtaatacggggtgatcaagcagctgcccttgcatcaatggcgaccacgcttcaagctgaatgccttgttcagtgcagaaagcaagcagttctttctgtgtcaggcgcgggtggtactccacctggttgatcatcggcttgatttccgtttctttcatgagatgtttcaggtggtgaatttggaaattgctgaccccgatcgccttaatgcgtccatcccggtagagggtttcgagcgcccgccacgcatcgatgtactttccttcgacaggccaatggatcaaatataaatctaaataatctaaaccgagtttttctaagcttgtgtcaaacgcttttaacgtttcttcatatcctaaatcggcattccatacttttgacgtgacaaaaatgtcttcacgttttaatcccgcttcttgcagcccttggcggatcccttcgccgacaccttcttcatttccgtaaatcgcggcggtatcaacgctgcgatagccgtgcaccaatgccgttttcaccgcgttgacgagttccgcgccttcctctactttgaaaactccgatgccgaaccaaggcatctctactccgttatgcaatgttgcttttgcttgtaaatgtgttgtcatgtatatattcctcctattatttgtctgtcgaaaaaaatcaaaatgcgctgaagaaaaactcacctcctttcaagggcagtgcgatcccgcttttccagcttcctgctccatccggttaatacgaccgcgctgagcaccatcagcgccccgatccaagcggtatgaatgattccgattgagtctgtaatgattccgccggcaaacgagccgatcgcgattccggcattaaatgccgcgatatttaaggctgatgctgtatcaacggcgcttggcgcaaaacgttcactcagcatcacgacatatacctgaagccccggcacattcataaacgccaacagccccatgaaaataatggtgatcagcccggctgttttaaacggcgcggtaaaagtcaggacaaacagcacagctgcctggacaatgaacatataaaacaaggctttcagcggattccggtttgataaacggccgccaatcatgtttccgatggcaatcgcaattccgtaaatgagcaggatggccgcgacggtttctttctgaaaacccgttacctcctgaagaagcggagataaatacgtaaacacgacaaacgttccgccgtagcctaacgctgtaataataaataaaagcaataaccggccgtttgtgacgagtttgacctgctcggaaaatgcggttttcgtccctttgcgcaaatgagacggaacgagaagcgcgtttgtgaggaatgcgatgattcctaccgccacaatcacggcaaatgcgattctccatccgaattgctggccgagataggtgccgaacggaacgccggtcaccgtagccaccgtcagccccgtgaacataatggaaatcgcgcttgctcttttatgctccggcacgatattggcggcgatcgttgccccgattgacatgaaaatgccgtgggaaaaagccgaaatgacccgtgccgccagtaagacgccgattgaggaagcgctcgctgcgagtgtatttccggcgataaaaatcaacatcacccagagcagcagtgttttccgcgacatgccggatgtgagagacgttaaaaccggcgcgccgaatgtcacgcccagagcatacatggaaacggtaagtcccgccgttgtcacaggtatatgcagatcttgagatataagcggcagcagtccgacgctgataaattcggttgtgccgatcgcaaaagcgctgacggctaatgccagcagcgctggtaaatagctttggcgatgtgaagacatctgttttcctccttaaacgataatgtatggttgaaatgatgccgggtaaacgatataagtataagagtacattccttttcagccggcaaatgtcattatgattgatagaagtgtcattgaaaagaacgtacttttaagtgccataggcactttttagttcctatagatgaggaggaattaccgttgctgaagaaaaaatacaatatatccgtagaggcggcgcttgaagtgatcggcggaaaatggaagtgtgtgatcctctgccacctcatgcgcgggaaaaaacggacaagcgaattgaagcggcttatgccggacatcacccagaagatgctgacacagcaattgcgggagctggaagctgacggcgtcatcaaccggatcgtgtacaatcaggtgccgccgaaagtggaatacgagctgagtgaatacgggcacagtctggaaagaattttaaatgcgctgtgtgactggggcgcgatgcatattgctaaacggtacggcgaggtgtcttccgttttagaggacagcattttgaatgacaaatttaaagaaccgggacaaatataagaaaaaagcaggcagcctgagacgctgatcctgctttttttatggaagaaaaatcattttatatgcaaaaaaaccgattgaacaacatattgatcggtataagggtggatttttatcaagttgtactggcggatttcttttaatgtgttatactatatataaataaaggtaaattagagtggcatattaaaaaggggtgacctgagcatgaaggtaaaagtagcaataaacgggtttggaagaatcggaagaatggtgttcagaaaagcaatggaagatgatcaaattcaaataacagccattaatgcaagctatcccccggaaacgcttgctcatttgataaagtatgacacaattcacggcaaataccatcaagaagttgagaccgccgacgacagcctgatcgtcaacggaaaacatattatgctgttcaatcgccgggacccgagagagcttccgtggaaagaatgcggaatagacatcgtcgtagaggcaacggggaaatttaattcaaaagaaaaagcgatgagccatattgaagcaggggcgaaaaaagtcattttaacggctccgggcaaaaatgaagacgttaccattgtcatgggagtaaatgaagagcagttcaatcccgatgaacatgtcattatttcaaatgcatcctgcacgacaaactgtcttgcgccggtcgtcaaagtgcttgatcaggaattcgggattgaaagcgggctgatgacgactgttcacgcttacacgaatgatcaaaaaaatatcgacaatccgcataaagatctgcggagggcgagagcgtgcggagaatccatcattccgacttctacaggcgccgctaaagcgctgtcgctcgtgctgcctcatttgaaaggaaaacttcacggtctcgctttgcgtgttcccgttccgaatgtgtcattagtggaccttgtctgcgatctgaaaacagatgtgtcggccgagcaagtgaacgccgctttccaaagagcctcaaaaacgtcgatgtacggaattcttgattattcggatgagccgctcgtttcttcggattataatacgaattcacactctgcgatcatcgacggactgacaacgatggtgatggaagaccgaaaagtaaaggtgctcgcctggtatgacaatgaatggggatattcctgccgggtcgttgatcttatccgtcacgtcgccgcgcgaatgaaacacccgtcagctgtgtagactaaagatcatggacatttgttagaaaaaaacccttaacggcatattcgcaaaaaacacaccttgcaaaataaacttaaacacagtatactatctttcgtgaacttcttgctcgtgactgcttcggaattacttaaagggttaggacctctccggactaactttcccccgtggtaaatggccgggtcagttctcggaaattcacttttttaattcttgttaaggggggtccatgattatggaaacaatggggcgtcacgtcatctccgagctgtggggatgcgattttgataagctcaatgacatggattttattgaaaaaacgtttgtaaatgctgctttgaaatcaggagctgaagtgcgcgaggtcgcatttcacaaatttgcaccgcaaggcgtaagcggagtcgttattatctctgagtcacatttaacgattcacagttttcctgaacacggatatgcaagcattgatgtttatacttgtggagacctggatcctaatgtggctgcggattacattgcggacgcattacatgcagatacaagagaaaacattgaaataccgagaggaatggggcctgtacagattaaacaggcacaagcgaaagtactgtaattttcaaaacgcaaacacaagggagctaagctgaaaaagccattacgcgctttgaagctgatgctccttttctaatgtaaaaaaacagcattgctttttctttaagcattttttttgtaaaatagaaaagataaggccggtctatcggctctcccaacaaataggctcatcctagaaacgttggcgggcatttaccggaagcttgcgaaccgcattacagcaacgaaacagatgggagctgatccaatttgaaatgtccttcatgccagcataacggttcccgcgtacttgattcacggcctgcggacgaagggaaatcaatccgcagaaggcgggaatgcgaagcctgccattaccgcttcactacatttgagaagtttgaagagatgcctctgatcgtcgtgaaaaaagaaggcgtccgggaagaattcagccgtgaaaaaatgctgcgcgggttaattaaagcttgtgaaaaaaggcccgttcctttgaaaacattggaagacatgtgctttgacattgaaaaagagctgagaaaccaaggcgtatctgaagtcaaaagcgaacttgtcggtgaaatggtaatggaccgcctggcgaaaatcgatgaggtgtcttatgtccgctttgcctccgtctaccggcagtttaaggatataaacgtgtttatcgatgaattgaaagatttaataaagaaagaacgctgagagagctaagagattgtgtctggctcttttctcatgagcaaaattggcatttgatagatcgcagaaacggtgtaaaatgagagtagaaacatatcggaaggtttgagaatcatggctgactattggaatgacgtattgcctgtagatccttatacggtcaaaagccgttcgcttcttcaggatgtcgacagacaggttttgacacatctgtaccagccgctgatcggttcttttgcattctccctttatatgaccttatggggggagcttgagcagaaccgcttgtggggagcggaatccacgcacaggcagctgatgggcatgatgcagtcaaatttaaaaaagattcatcatgaacagggaaagcttgaaggaatcggactgctgaaagtgtatatccgggagtccgagcaaaaagagcggatgtttatttatgagctgctgcccccgctcaggccgaatgatttttttgaagacggcatgctgaatgtctttctttataacagagtcggtaaaacgaaataccagcagctgagacaattttacacgcacccttccgtcggcgcgggcgcaagggaaattacccgtccgtttaatcacgcttttgcctcttttcagccgagtgaatggaaaatgacgcctgatatggaagaggcgatgaagctccccgaggactatgagacggcgtctgtcggacaagcgccttcctatacggtgacggaggaagtgtttgattttgagctgtttttggcggggttatcagaaacgatgataccgcgcaaatcaatcacacaggatgtgcgggagagcattaaaaagctttcatatttatacggaatagatcctatctccatgcagcacgtcgtcatgaccgcaattaatgagcaggatacgataacggccgaagcgctgaggaaagcggccagcgactggtaccaaattgaaagaagcggcaagcttcccgaactgattgataaaacacagcctgtcaccttgagagaaaaccggacggaaaaggacgattcattgaacggcgaactcatcgcacagcttgagaccatatcaccgagaaagcttctccaggacattgcggacgggaccgagccgtcaaaagccgacctgcagattatcgccgatattatgttcgaacaaaagcttgagcccggcgtcaccaatgtgctgatttattatgtcatgctgaaaacggatatgaagctgtccaaaaactatatccaaaaaatcgccgcccactgggccagaaagaaagtcaaaacggtacgggaagcaatgaagctcgcaatcgaagagcacaggcaatatcttgattgggcggacggcaaaacaaacggcgcggcgcgcggcaaaaaaaccgtccgggaagaaaagcgccctgattggatgaaagaagaagaaaccgggaagaaacaagaacagacggctctttccgcacaggatcttgaagaacagaagaaaaaaatgatggaagaaatgaaaaaactgaaaaaatactctgcctattgagacagagaagcggggtgatattgaatggaaccgatcagccgatccttagaaggcgtgacgaaaagacctgactttcaaaaacgcctggaacgaatgcagcagcaagttatggccgacgaagacgtccaggcttttttgaaggaacagaaagatgttatcaatcaaagcatgattgacagagggttaaataaactgtacgaattcgttcagcaaagtaaacagtgcgccttctgttcgaaagacagccggacgaacagcctgcttgaaggctaccatccgaagcttgtgatcaacgggcgttccattgatattgaatattacgaatgtccggaaaagagaaagctcgaccgccagaaaaggcaaaagtccctgatgaagagcatgtatatccagcaggatcttctcggcgcgacgtttcagcagatcgacattaccgatccgagcagactcggcattttccagcatgtgacggattttctgaagagctataatgaaacgggaaaaggcaaagggctgtatctgtacggaaaattcggaatcggaaagacatttattttagccgccattgccaatgaactggcggaaaaagagtattcatcaatgatcgtatatgttcccgaatttgtcagagagctgaaaaactcgcttcaggatcagtcgctggaggcgaaactgaatatggtgaaaacgacgcccgtactgatgcttgatgacatcggagcggagtcaatgacaagctgggtcagggatgaagtcatcggcaccgtgcttcagcacagaatgagccagcagcttcccactttcttctcgtctaatttttcaccagacgagctgaagcatcattttacgtattcacagcggggagaaaaggaagaagtaaaagcggcaagactgatggagcggattttatatttggcttcgcccgtccgtcttgacggggaaaaccgccgccgttcatgatgccggcgtccaatgggaaggatttgagggaatgaggaataagaaggctgtcacttgggctgcggctgcggcgggagcgggtcttttgctgtgggcaaaccgcaaatatctgaatctgtcgcctaaggagatccggctgtgggtgttatcgttcggtgtttttgcgccgcttgtgtttatcggaatttccatcgtcaggccttttgtgctgtttcccgtatcaatcgtttccgtcgccggaggattggcgttcggcccgtttttcggcaccatgtatacgctggcgggctcaatgggcgctgccgccgcgtctttttttgcggcggggctgtttgcctttaatgagaaaagccgtcatggaaaaatggaagccattcaaaagcagatgaaaaccaatggcttcttttatatttttatcctgcgcattctgcctgttaactttgatgtgatcagctatgccgcgggcctatcgaaagtcaggccggtaacgtattttttggcgaccgcagcgggcatcattccggggacgatcgtcctgaatgtgctcggcgcgagctttatgtccggcaatgtgctggccgtactctgcgtgatctgtctttacgtcgtatttttatcgcttcccgttatatttaaaaagaaggtgcgtcatttgttcggcggtgaaagctaacctttacgtctattttaaaaacatcccccatatacttgtaacagatgccgtaaggggggacaaatatgcttgaagtgatctttgaagatgaccacgataccgccgcttttttacatctcattcagcaatcggacgaccggagacattttattgtccgtgaaggcataaaaaaagtcggaatcgcaaggtctgaaacggctttttgcgttcagcgctttattgagccgatacttgtcaggttttttttggaatgcaaagaagacgagcatatgctttcgcttattgaggacgcatactgcttcaccgatcaggatgaacagcagcaaatccttcagcttgcacacagcattatggaaggagagcttgaggatcatccgtttgagccgaagaaagagccgcgcacacagtttatttcagatgcgctccgaacgatttcacttgatgcgggtgttttttccgtgcgttcgtttcagacgttccggctcggcaggtattatgagaggctcagagaatatacggaggccgcgatagatgaataccggatggaacaggaatatcaaaactttatccagtctctgagagattatgtgacatccaatccgccgcggatgaagaaagtccgcatcgtacatgaccgggcttttacgctgtgggagctgcgctatgtgtctgaacgggaacagaaaaaatacatagacagacggtttgtgcgggagcacccgatgtatatagattcccatctccttgcgccgctgatctccattgcgcctgagacggtcgaactgtatacggacaaaccggaacatatgatgtcaagaaccattcaaaacgtgtttcaggagagggtgcgcctttttccgctgggcgcgtttgcagccgagaagacggaaggatagccgcacggacggccttgtgtaagcggcagggctgtctgtgcgaaatcagacggaaaaccgagttgcatttttctcacagacattttataatacataaaagattaatgattgctacacgtattgataaggacatgaagcattgataccggctgtataagagaggagagcccaggctgaaagctttccagctatggatcattgtctttaccgcctttgaacttcagctgtgaacgccggaataagcgccagtaatagctgacgggaactcccgttacagagcttagagccgcagtgccgaagcaatcggccgcgcggaaaaaagggtggaaccacgattccgtttatttaacctcgtccctttcatagggggcggggtttttgatttgcataaaaaaaggagtgacgaagatgtcagatatgatcaacatcacatttccggacggagcggtaaaggaatttccgaaaggaactacaacagaagatatcgcggcatccatcagtccgggattaaagaaaaagtctttagccggaaaactgaacggacaggaaattgatttaagaacgccgattcaagaggacggtgccgtagaaatcattacagaaggcacagaagaaggtttgaacatcatgcggcacagcacggcgcatttattggcccaggcgattaaacgcatttataaagatgtgaaattcggagtcggccccgtcattgaaaacgggttctattatgacgttgaaatggagcaggcgctgacgccggatgaccttccgaagattgaaaaagaaatgaaacgcatcatcggtgaaaatctgccgatcatccgaaaagaagtgagccgtgatgaagcaaaagccatgtttgcggaaatcggcgataatctgaagcttgaactgctggatgcgattccagaagacgaaacggtctctatttatgagcagggcgaattttttgacctgtgccgcggcgtgcacgtgccgtctacaggcaaaattaaagaatttaagctgctgagccttgcgggcgcatactggcgcggcgacagcaaaaaccaaatgcttcagcggatttacggcacggctttctttaaaaaggatgacttgaaagagcatttgcgcatgcttgaagaagcgaaagagcgtgaccaccgaaaactgggcaaagaattaaaattgtttgccaactctcaaaaagtcggacaaggtctgccgctctggctgccgaaaggcgcgaccatccgccgcgtgatcgagcgctacattgtggataaagagctgagcctcggttatgagcatgtgtatacgcctgtcctcggaagcaaagacctgtacgaaacatcagggcactgggatcattatcaggatacaatgttccctccgatggaaatggacaatgaaacactcgtgctccgtccgatgaactgtcctcaccatatgatgatttacaaacaggacattcacagctaccgcgagcttccgatccgcatcgccgagctcggaacgatgcatcgttatgaaatgtccggggcgctttcaggtcttcagcgcgtacgcggcatgacgttaaatgacgcgcacattttcgtccgccctgatcagattaaagaagaattcatccgcaccgtccgtttgattcaagacgtatacgaagacttcggactgagtgattacacattccgcctgtcttaccgcgatcctgaagatacggaaaaatattttgatgatgatgagatgtggaacaaagcgcaatccatgctgaaggcggcaatggatgagatggggcacgactattatgaagcggaaggcgaagcggcgttttacggccctaaacttgacgtgcaggtgaaaacggcgatcggcaaagaagagacattgtcaactgtacagcttgacttccttcttccggaacgctttgatctcacttacgtcggagaagacggcaaacagcaccgccctgtcgttattcaccgcggcgtcgtatcaacgatggagcgtttcgttgctttcttaatcgaagagcacaaaggcgcccttccgacatggcttgcgccggtgcaattccaagtcattcctgtatcaccgtccgtgcatcttgactacgcgaaaaaagtgcaggagcgcctgcagcgcgaaggcctgcgtgtcgagcttgacagccgggacgaaaaaatcggctataaaatccgtgaagcgcaaatgcaaaaaatcccgtacatgcttgtggtcggtgaccaagaagcggaaaacggcgcggtaaacgtccggaaatacggcgagcagaaatcagaaaccgtctcattggacgattttgtgaaaaaggctgtagcagaagcgaaaaaataaccggaaatacaaaaaaccccgttcattcagaatggggtttttttgcgtataaaattatctttctttttgtttctctataatcgcaaacagctcgtgaagatcgctgatcacgtaatcaggcgcaatgtccgtatcatttttcttttgtgtccggtttacccagactgtcgtaatgcctgcccgtttcgctcccaatatatcagtattgaggttatctccgaccataatggcgtcttcttttttcaggttcaggaggccgaggcaatgttcgaatatggaggcatcgggtttcccttttccgaaagcgcctgagatgacgatttcattaaaataaggcgcgagctcaggaacgccggctagtttttctttctgcaggctgggatcgccgtttgtcagcagaagcaattcataaacacctttcagcttatcaagcaccgcaaacgtttcatcatacacatacgggcgctgtctgcgttccgccgcgaaaaactccgccaaatattcgccgtaagccgcatcgtctataccgacgctttttaagccgttcgtccaggcgtttcgtctgtattccggcgcaatccgattcagctgtttaaatccttcgctgaccggctcggaaaaattcgcccataatccttcaaacggattaatgccgatcatgaccgtataaggataggtttcgtatgacatatacaattcccgtgccgctttccgtaccgcctcttcaaatgtttgcgggtcaaggccatattttttttccgcttgtaaacatgtttccctgaatgttgttctgacgcttttttcatcccataacagtgtatcgtccaaatcaaaaaatacggctttcatgatcttctcctctttgttatattctgaaactctctgccgcaaggctcccgtttattctacaatagatacatagactgtgaaagatttgttttcagatgatttgaaaaaaacaggcaggtttgtgtcagattctgtctcgggctctaaaacgtgataaaataaaatttgaaagaacaggtgaaaagtatgctgcatttgatcatcatgatgctggaaagagtcggaattatcgtcatattgggatttgttctggctcataccagattgttcagacaggcgctccagcagcctgagagctataaaggcaaagcggtgctgatttcaattttctcgctgttcagtatcatcagcaactatacgggaatagaaattcagcagaatacaatcatgaataatgactgggtgtttcaaattaatccgtccggttcaattgccaatacaagaattatgggcgttgaaatcggcggactcttaggcggcccctatgtggggatcggcgtcggcatactggccggcctgcatcgtttatcactcggcggcgcgaccgcagtcagctgtgccgtctcatccgttttagcgggcattttgtccggctggatcggacggtatttcagaaaacgctacaggatgccgacaccgcgtgtggccgcgcttgtcggactcgggatggaatcgctgcaaatgctgctcatcctcttgatggccaagccgttttctgacgcttggacgcttgtgagcatcatcggcatcccgatgatattggtaaacgggtcagggacttttatttttctttcgatcattcagtcgattatccggaaggaagaacgggcgagagcccttgaaacccacagggtgctgatgattgccgatcagacgcttccgtatttccgccaggggctgaatgaaagctcatgcaaaagcgtcgccgccatcattcacaggcaaacaggaacggacgcggtatcgcttacggataacgaaaagattttggcgcacgtcggcgcgggtgccgaccatcatattccgtctgaaagcctgattaccggattgtcaaagcgcgttattaaaacgggtcatattatgaaagcgacatcaaaggaagaaattgaatgcacgcacgatccctgtccgctgcatgcggcgattgtattgccgctgacgtcaaacggcaaaacgatcgggacgctgaaaatgtactttaaaagcccgtcaggtttaagccgggttgaagaagagcttgcagaaggactcgccatgctgttttccacacagcttgaactcggcgaggcggaactgcagagcaaattgctgaaagacgcagaaataaaagcgcttcaagcacaggtcaatccgcattttctgtttaatgcgatcaatacgatttctgctctttgccgtacggatgtagaaaaaacccgaaagcttctgctgcagctcagcgtctatttccgttccaatctccagggggcaaggcagctgctcatcccgctttctaaagaactgaaccatctgcaggcgtatttatcattggagcaggcccgttttcctgggaaatataaaatcagccttgaaatcgaacgcggtttggaggacatcgaaattcctccttttgtgctgcagattctcgtcgaaaatgcgcttcgccatgcattttcaagaaagcaggacagctgtgccgtcaatgtgagcgtggtatccgccggtcagtcggttttaatgcgggttggagataacgggcggggaattgatccggaattgctgtccgtgctcggaaaccgtccgctcccgtctaaagaagggacgggaaccgcgctttacaatttaaatcagcggctgatcgggctgttcggccccaaggcagccctgcgattggaaagtgaggccggcaaaggtacggacgtatcatttgagctgcctttgaaactgatgactaaaggagaagaacatgctgaaggtgttaatcgttgatgatgaaatgctggcaagagatgaattagcttatttgctgaaacggacgaatgaagtaagtgacataaacgaagctgaaaatattgaatccgcttttgacagtatgatggatcaaaaaccggatctgctgtttttggacgttgatttgtcaggagaaaacggatttgatattgccaaacggctgaaaaacatgaaaaatccgccggccgtcgtttttgcgacggcgtatgaccaatttgctttaaaagcttttgaagtcgacgcactcgattatttaacgaagccttttgatgaagaaagagtgcgccagacgatcagaaagtttaaaagagtgaagcaggacagggcaggagccgtctcggagctgccgtccgcagccggagcgcataaactggctgtatcagccggtgaatctattgtcattttagatacgaaggacattatttacgccggcatggaggacggacacgtttccgtcaaaacgtttgccgcgtcttattccgttcatgaaactttggcggtcattgagaaaaaactgcctgatacgggtttcttgagagtgcaccgcgcgttcatcgtgaatacggagcatattacggaaattcatccgtggtttaattcgacttacaatctgatattaaaagacggttctaaaattcccgtcagccgtacatacgccaaggacttaaaaaagctgcttcatattatatgaggcggcttttgcatttcagcagccgttttttgcatttcagaatgaatattcagccgtttgttatgaaagcgctttaaaaatcgatttctcttttataatggacctaacaaagagaaagaggtgaagaaaatgagtgcgaaaaaagtgtacggatttctgacacaagcatttatttttgccgtagttatgctcatatctaatgggattgcagcgattgtccccattcctatacccgcttccgtagtaggtttggtgttattatttgtcctcttatgcctgaaagtgattaagcttgaacaagtagaaacgctgggaacatcattaacgtcactgatcggatttttatttgtcccgtcgggcatctccgtgatgaattcacttggcgtcatgcagcagtacggcgtgcagatcgcactcgtcatcttactcgccaccatcattctgttaggggcgacaggccttttttctcagctgatcttgtctgtcagccaaaaacgtcagaaggctgctccggctgataaacaaacggtgcgccgttccaatcaggaaaacgaacttgtgcagcattaggagggaaaacggatgagtccatatttcggtattgtcgtttcacttgcggcctttggcatcggcacgtatttatttaaaaaaacgagaggctttttcctcttcaccccgctgtttgttgcgatggtgcttggaattctttttctgaagctcggcggtttttcgtatgaagattataaaagcggaggagacattattaaattcttcctggagcccgcgacgatcgcttttgccatccctttatacaaacagcgtgccaagctgaaaaaatactggtggcagatcatgtcttccatcattgtcggctctatctgctcagtcacgattgtctatttgatcgcaaaaggcattcatctcgacgcggccgttatgaaaagcatgcttccgcaggcggcgacaacggcaattgcccttccgctgtcaaaagggatcggcggcatcaccgacatcaccgctttcgccgttattttcaacgccgttatcgtctatgctcttggcgctttattcttaaaactgtttaaagtaaagcacccaatctctaagggactggctctcggcacatcaggacacgcactcggtgttgcggtcggcattgagatgggggaagtagaagcggcaatggcaagtatcgcggttgtcgtcgtaggagtggtgacggtgctggtcattccggtattcgttcagctcatcggaggataaacccgggtcatagacccgggttttttattgtgttggcacgtccgcgggcggcaaagaacgaaatttcacatttttccttgcgctcaccccggcatcgtgttaaaatgaaaaagttgatccggagaagtcattcttgactaatgatccggtattgtgtagaatagttattgaattgaatataaatcacaagcagaggcacccgcttctcacctgattgacacattcatgtagttggcaggttgaccgtacatttttatttatgcagatgttcgtagtgtgggtgtgttgtcatgcccgcactttttgtttgcctgcagaatgcagtcaaaaagcgttgtgaatcaattcgaagaaactatggaggtggctcattattagcaaagatcaattggttaatgagggtatccgtgcacgtgaagttcgtctgatcggacaaaatggcgatcagctcggcatcaagtcccgtcaggaagcacttgaaatcgccggccgcgcaaatcttgaccttgtgttagttgcagcaaatgcaaaaccgcctgtctgccgcatcatggactacggtaagttccgattcgagcagcagaaaaaggacaaagaagcacgcaaaaatcaaaaaatcattaacttaaaagaagttagattaagtccgacgatcgatgagcatgactttaacacgaaattgcgcaatgcgattaaattccttgaaaaaggcgataaagtgaaagcttctatccgctttaaagggcgcgcaatcactcataaagaaatcggccagcgcgtattggaccgtttctctgaagcatgtgcggaagttgcgacagtcgaaacaaaaccaaaaatggacggccgcagcatgttcttaatgctcgcgccgaaaaacgaaaagcaataaggaggaaatcccatgccaaaaatgaaaactcaccgcggatctgctaaacgttttaaaaagacaggttctgggaagttaaaacgttctcatgcatacacaagtcacttattcgccaacaaatcccaaaagcaaaagcgtaagcttcgcaagggtgctattgtgagcgcaggagacttcaaacgcatcaaacaacagcttgccaacatcaagtaatcggacaaggaacaattaggagggaaatctaatgccaagagtaaaaggcggaactgttacacgtaagcgtcgtaaaaaggttcttaaattagcaaaaggttatttcggttcaaaacatacattatacaaagtagcaaaccagcaggtcatgaaatcaggaaactatgcattccgtgaccgccgtcagaaaaaacgtgatttccgtaagctttggatcactcgtatcaacgctgctgcacgtatgaacggtctttcttacagccgtttaatgcacggtcttaagctttcaggcatcgaagtaaaccgcaaaatgcttgctgatcttgctgtaaacgatcttactgctttcaatcagcttgctgatgctgctaaagctcagttagacaagtaagttgaaaaagccgctctctttccgggagcggtttttttacgtaaagggtgacaatcaatggctctcttcatttacgccgtattgataaacggatacggcttttggatcatgggcgctgataaaagaagagcaaaggcgcacaggtggagaatatcagagaaacgaatatggctcacagccgccatgttcggctcactcggcgtatggatcggcatgcgcaccttcaggcataagacgaagcacaaatcctttttatacggggtgccgctgctttttctcactgaagccgcccttgtgctcatgtatttgatgtataaaaaataaaaagcaggagagcttatcgctcgcctgcttttttcgcttttttgatgggctggtcccaatcaatcttgcaattcggataccgctccaatacctttttttcgacttcttcaaaatcatctgcagaaaagcggttcagcttttccggattttcggtccatacaaatattgtatggataaacagcggatgatctttggaagggatatgcttttctccttcaaagagcactcctttataagtaagctggagattttttcgcgtgtttttctgttcgtcaataaaataaaaattctcttttgattgcgccagtctgagccttcttttcgggtttgcgtaaaatttgacgcacatgtaaataaaataaataagaagtgcaagcaagacaatcctcaatactgtaatggccatatgtgtgaaggcacctcctcacctttgtcatgatctgatgtaatacgaaaaacaaaacaaaaagtttcatttttttaaaagaaatagataaaaacatttacccgtttttcaggcgaattaatcgtatgcttcagcattggttttgtataataagaagggtagtgaaaaaaaggaggtttattgatgacaaaattagatgaaacgctcaccatgctgaaagcgttaacggatgcaaaagggataccgggaaatgagagagaagtaagacaagtgatgaaatcatacatagaaccatttgccgatgatgtcacaacagaccggctgggaagtttaatcgccaaaaaaaccggcaaagaaaacggtccgaaaatcatgatctcagggcatttagacgaagtcggttttatggtgacgcaaatcactgataaaggctttctccgctttcaaaccgtcggcggctggtggtctcaggtcatgctggcccagcgcgtcaccgtcgtgacaaaaaaaggggacatcacggggatcatcggttcgaaaccgcctcacattctgcctcctgacgccagaaaaaaagccgctgatattaaagagatgttcatcgatatcggggcgtccagccgtgaagaagcaatggaatggggcgttcttccgggtgatcagattgtgccgtattttgaatttacagtgatgaacaatgaaaagcatttattggcgaaagcgtgggacaaccgtatcggctgtgcgattgccatcgatgtattaaaaaatctgaaaaacagtgatcacccgaatgaagtatacggggtcggaacggttcaagaagaagtcgggctgcgcggggcgaaaacagcggcacatacgatccagcctgatatcgcgttcggtgtggatgtcggaattgccggagatacaccgggaatttctgaaaaagaggcgcaaagcaaaatcggcgaagggccgcaaattattctgtatgacgcgtcaatggtatctcacaaagggctgcgcgaccttgtcgtaaacacggcggaagaagcgggaattccgtatcaattcgattccattgccggagggggcacggattcaggttctattcatttaaccgcaaacggagtgccggcgctgtccattacgatcgcgacgcgctacattcacactcatgccgctattttgcatcgggatgattatgagaatacggtaaaattgatcacagaagtaattaaaaaattagaccgggaaacggttgaccgtattacttatcaataaagatacggaagaatctgcttttttaagcagattctttttttttgtctgtacaaatatgagccttgcgtctacaataagaaaagacatagaaaaatctgacaacatgtttttgaaagcgctttaaaaaaagggaggtttacaaatgaaaaacagattcagacgcatgatccgcttttcatgcgcagtcgttacagccggtctgcttctgatgtcttcatctccggcatctgccgcgttttggggggcatcaaatgaattgcttcacgatccgacaatggcgaaggaaggaaacacgtggtacgctttcggaaccggtttggaaggggagagggggcttcgcgtcttaaaggcgggcagcggcggcgtatggaccgttcagaaatcaatctttacttccccgctgtcatggtggggcaattatgtgccgaattacgggctgaatcaatgggcccccgatgttcaatattttaacggaaagtattggctgtattatgccgtttcttcattcggcaaaaatacctccgcgatcggtcttgcatcatctacaagcctcagttcgggaaactggaaggacgaagggcttgtcatccgttcgacaagcgccaataactacaatgcaattgatccggagctgacaattgataaagacggaaacccttggcttgccttcggttctttttggagcggcattaagctgacaaagcttgataaaaatacaatgaaaccgacgggatcactttattccatcgctgccagaccgaataacggcggagctttggaagcgccggccatcacctaccagaacggctactattacttaatggtgtcgtttgataaatgctgttcaggggtgaatagtacgtacaaaatcgcttatggaagatccaaaagcatcaccggcccatatctcgataaaagcgggaaaagcatgtctgaaggcggagggacgattcttgattccggcaatgaccgctggaaaggcccgggcggtcaagacattgtgaacgggaatattttagtgcgtcatgcgtatgatgccgaaaacagcggaattccgaagatgctcatcaatgatatcgattggagttcaggctggccttcctattaattgatcagccgggcatgtgtgtccggcttttttacttgcaataaaagattgacagtttgattcctccttaactataataaagttgttcgtacaaataaaagaataaaagttttattatttatattcgtacgtatatttatttaaaaatgcaagcgctttattttgatgggaaggggaaatgaatgtgcttcagaacaaagaatatgaattttggtttgtaacgggaagccagcacttatacggagaggaaacgctgcagcttgtcgataaacacgcaaagggaatatgtgacggtctcagcggggtgtcatcaagatacaagatcaggcataaaccggttgtcacgtcatctgaaacgatcagagaggttttgcgggaagcgcagtatcaagaaaactgtgccggggtcgtgacgtggatgcatacattttcccctgcgaaaatgtggattgaaggtctttccgcttttcaaaagccgatgcttcatctgcatacccagtatcatcgcgacatcccgtgggaaacgattgatatggactttatgaacagcaaccaatccgctcacggagaccgggagtacggatatatccagtcaagaatggggcagacgagaaaagtcatcgcaggctattgggatgatgaggaagtcaaacatgacatttcgcaatggatgaacacggctgccgcttggaatgaaagcaggaatattaaagtagcccggttcggcgacaatatgcggaatgtggcggttactgacggagacaaagtcggcgcccacattcaattcggctggcaggttgacgggtacggaatcggcgatcttaccgaggtgatgaacaatgtcaccgacgcagaaattgaggcgctttatgaggaatacgacaaattgtatgtcatcagcgacgaaacgaagcgggatgaagcaaaagttgcttccattaaagaacaggcgaaaattgaactcggattaacggcctttctcgaacggggcggatatacagcgttttcgacctcctttgaagttttgcacggaatgaagcagcttccgggtcttgccgttcagcgtctcatggaaaaagggtacggatttgccggcgaaggcgattggaaaacggctgcccttgtgcgaatgatgaaaataatggcggacggagaacaaacctccttcatggaagattatacgtaccattttgaaccgggtcgtgcgatgattctcggatcacatatgcttgaagtatgtccgacgatcgcccttgatcagccgaaaatcgaagtccatccgctctcaatcggagggaaggaagatccggcccggctggtttttaacggaatcggcggttcagccatcatcgccagcatcattgatatcggcgggcggttccgtctcattctgaatgaagcggaaggcagggaaattgatcatgatatgccgaatctccctgtggcgcgggtgctgtggaagccggagccatcgctgaaaacagctgcggaagcatggattctggcgggaggcgcccaccatacctgtatgtccttccggcttacggctgaacagatgcttgactgggctgagatggcaggcattgaaagcatctttatttcccgcaatactgaaatacatgagctgaaaaaagagctgaaatggaatgacgtattataccggctgggagggaattgatatggcgtatacgattggtgttgatttcggcacattgtccggccgggcggtgcttgtcaatgtccgcacgggcgaagaaatcgcgtctgcggtaaaagaatacactcatgccgtcatcgaccgcacgctgccgaagacgggtgaaaaactccctcgggactgggcgcttcagcatcctgccgattatatcgaagttctggaaacggcgattccgaacctgcttgagcaggcgggcgctgatccaaaagacgtgatcggcataggaattgatttcaccgcctgcacgattttaccgatagacggcgcggggcagccgctttgtatgctgccggaatttgaacgggagccccacagttatgtgaagctgtggaagcatcatgcggctcaaaaacatgcagaccgtttgaacacgattgccgaagacacaaaagaaacattccttaaaagatacggcggtaaaatttcttctgaatggatgatcccgaaaatcatgcaaatcgcggaagaagcgccgcatatatacaaggcggcagatcggattgtggaagcggcagactggatcgtctatcaattgtgcggttcattgaagcgaagcaactgcacggccggctacaaagcaatctggaatgaggagacggggtatccgccggatcattttttcgaaaagctcaacccgttaatgaaaacgattacacaggataaattaagcggcgcgatttattcagtcggggaaaaagcaggaggtttgaccgaaaaaatggcggagctgaccgggcttctgccggggacggccgttgccgtcgccaatgtcgacgctcatgtgtcagtgcccgcggtcggtattacagagccggggaaaatgctgatgatcatgggaacgtctacctgccatgtgctgctcggcgaggaagaacatatcgtccccggtatgtgcggggtcgtcaataacggcattttgcccggatatgcgggatatgaagcggggcagtcctgtgtcggcgaccactttgaatggttcgtcaaaacgtgcgttccgagagactatgagaaggaagctgaggataaacacatagacattcacgagctgctcagcaaaaaagcagcagaacttgttcccggggaaagcggccttctcgcgcttgactggtggaacggaaaccggtcaaccttggtggacgccgatttgacgggcatgatgctcggcatgacgctgcacacgaagcccgaagaaatctacagggcattgattgaagcgacggcgttcggaacgaggatgattatcgaaacgttccgggaaaacggcgttccggtcgaggagctttacgcagccggaggaatcgccgaaaaaaatccgtttgtcatgcagatttacgcagacgtcacaaatatggacattcaattatccggatctccgcaggcgcctgcactgggctccgcgattttcggagcgctcgccgcgggacgggaaaacggaggattctccaatattgctgaagcttgcgcgcatatggggaaattaaaagacggcttttatgccccgaaccgggaaagagctgagatttatgacagcttatatgcggaatataaagagctcgtacactacttcggcaaagaaaacaatgtcatgaaacgcctgaaagccattaaaaaccgtgattttgcgaaaggggggagccgccatgcttgaagcgttaaaagaagaagtgctcgccgccaatctgaagcttgaggaacataaccttgtcacgtttacatgggggaatgtcagcggcattgacagagagagcgggagaatcgtcattaaaccgagcggtgtcgattacagtgagctgaccgctgacaagctggtcgtcctgaatgaggacggagacattttggaaggctcgctgaaaccgtcttctgacacgccgacccatctttatctgtataaagcgtttccggctatcggcggaatcgttcatactcactcccgctgggcgacgagctgggcgcagtccggaagagacatacccgctctcggaacgactcacgcggattactttgaaagcgctataccctgcacgagggaaatgtatgaagaagaaattgtgaaagattacgagtatcatacaggcaaagttatagccgaaacctttcaaaacgaaccgtatgaacaaaatccgggtgtcctcgtccacagccacggcccgttctgctggggaacggacgcgctgaatgccctgcataacgccgttgtgctcgaaacggtagcggaaatggcctaccattcgcttatgctgaacaaacagctcagtccgatcgacagagtgctgcatgataagcatttttacagaaaacacggggcgaatgcttattatggccaaacttgacgcagccgggtttctgattgatttagacggaaccgtattcagggggcgggagctgattgacggcgcaaaagaagccgttcatacccttcagtcactgggcaaagccgttgtctttttaagcaaccgcggcaatctatcaaaagcaatgtgcagaaagaaactgctgggtgccggtatccgcacggatgaacggagcatcgtgctgtcctccagtgtgacggcatcatttttaaagaagcattatcctttgtcaaaggtctgggtgttaggagagaaagggctgactgatgaactcgctttagcgggtgtcgtcctggcgcaaaacccgcaggcggcagactggcttgtcatctccctgcatgaaaccgtcacctataaggatctgaatctcgcttttaaggcggcttcctccggcgcgcgcatcatcgccacgaacaaagaccgctcctttccgaatgaaggcggtcatgccatggatgtcgcgggaatgatcggggccattgaagcatccgccggagcaaaaacggagcttgtcatcggcaaaccgtcttggctgatggctgaggcggcatgtgaagcgctcggacttccccctgaggaatgcgccataatcggagacagcctcgaatctgatatcgcaatgggcaggctgtacggaatgaaaagcatattggttctgacggggtcggccaaacttggggagccccgtctatatgaacctgacatcgtccttgattctattaaagacctgacagaattagcgaaggagggaatccttttatgaaacgttctcctgaggacattcaatccgagtttgacaaggaaggggccagccgctcaccgattcaaatagaagatatcgtgatcggggcgaatgcaaaagaagagcttctcagatttctgcaaaaaaaatgctggaatcatccggtcatcgtctgtgaccggaacacgtacgaggcggcgggacgtctgcttgcggacgaattaagggcaggcggaatcaaagcgtcaaaagtcatcattccggagcatgaagccggggccgccgcggctgatgagaggacattggtctatacgctgatcaatctcgcggaagagacggatgttatcatagcggccggttcaggaacgattcacgacattacgcggtttgccgcttatcagcgcggattgccgtttatctcattccccaccgctccgtcagtcgacggttttacatcggcgggagcgccgctcatattaaacggaatcaaaacgacgattcaaacgaaagcgcccatcgccttatttgccgatacgaatgtattaaaagaagcgccccgttcaatgacagccgcgggcttcggagacatgctcgggaaaataacatcgctggctgattgggagatttcccgcaggcttgcgggtgagccgtactcagaagccggggcgaagcttgtgaaagacgcgctttggcagtgcattgatcaccgcgctgacattgccatgggaacggaggccggcattcagatactgatggaagcgctgatcgtttcgggtcttgtcatgcttgctcttgaccactcccgccccgcctcaggaggagagcatcacatctcgcattggattgagatggaaatgctgaaggcaaaacagcctccgattctccacggtgcgaaggtcggctgtgcgtgcgcggtgctgagtgatatttacaaagaactggcttgtcacgaaaagcttgctgaactgccgccgcactttcgcgaggcgattcagtccgcatatgaagggcttcccgacggcaaaacaattgccgggtggctctcatctgcgggaggtcccgcctgtttcgatgagatcggtgtaaaaaaggaccttgtcagcgatgcgcttaagcatgcgcacacactgcgagaccgttataccggtttaaccatcataaatgaaaatgcagcgctctttgcacatcatttgcatcaatagccgcacggcctaaagtggaaggggtaatgacatgaaaaaaacgaccgctgtatgtttggtgctgatgatgctcttcttgtttaccgccggctgttcacaagaacggactgccggccggccgggagaaacggagctgacgttttggacgtttaacggtctgcacgaacagttttatcaggaaatggtcaaagaatggaatcagaagtatccggatcgcaaaatcaagctgaataccgttgtttatccttatggacaaatgcatgataatttatcggtttcgctgatcgcgggtgaggggcttcccgatatagccgacgtggaattaagccggttctcgaactttctgaaggggaaggatatcccgcttgccgatctgacgccgctgattgaaaaagaccgcgataagtttgtggaagcgcgtctggccttatacagcaaaaacggaaaattgtacggccttgatacacatgtggggacgaccgtcatgttttacaacatggatatcatgaaaaaagcgggcgttgatcccgcctccattaagacatgggaagattaccggcgggcaggaaaaaaagtgcgtgaagccgctgggaaaccgatgggaacggttgaaacaaacgactccgccacattcctatccatgatttcgcagcaagggtcaggctactacagcaaaaacggaaaattgattctgaacagcaagacgaatacagatacactgaatgatgtaaaggacatggtaaatgataaaacccttctgccggctcccggcggcggccatcacagcgaagaatactacggttttatgaatcagggcggggcagcctcagtgctgatgcccatttggtacatgggacggtttatcgattatatgcctgatttaaaagggaaaatggcgatttaccctatgccggcctggaaagaaggcggtgacagatcagcgggtttaggcggaacagccaccgtcgtgccgaagcaggctgaacatctggagctcgcgaaagaatttctcggatttgcgaaaggttcaaaggaagggaacataaagctgtggacggtgctcggctttgacccgctccgctgggacgtgtgggattcaaaagaattgaaggagaaaaacaagtacacggatttcttccggaacggtacgtcaattttttcctcgctccttgaaataaaagatgagatcaatccgatttatctgcatgaagacttctctaaagcggctgatctcgttgtcagacaggtgctgttcgatgcgctgaagacgcaggaaaaaacacctgaggaagccttggacgaggcggcagagcaattagaaaaataggagaagccgccctatttaacagtgaaagcgggggagcttttatgagacctgtaaagacagagacagcgcaaaccgtttctgcagtccggaagaagccgcgccggcgcaatgtgctgtattcaaaaaaagcggcgccttatctttttacggcgccatttatcatttcgtttctcgttttctttttgtatccgatcatcagcgtgtttatcatgagctttcagcggatactgccgggagaaattacatttgtcgggttttccaattataccgctcttcttaatccaaccttttatacggcattatttaacacattggaatatactttctggacgctgatcgtgctgattccggtgccgcttcttttagcggtgattctgaattcgaagctcgtcaggttcagaaatgtgtttaaatcggctctgtttgtaccggctttaacatcgacgatcgtagcggggattattttccggctgatgttcggagaaatgaatacgtcgcttgcaaacgagctgatgatgaagcttggcgcatcaccccaaaactggctcaacaacaaaggtaccggcatgtttttaatggtgctgcttgcgtcatggaggtggatggggattaacattctttactttctggcgggtttgcaaaatgtgccgaaagaattgtatgaggcggctgaaattgacggggcgagtacgtggaaaaagttccggcatatcacccttccatttttaaagccggtgtccgtttatgtgttaacgatcagtatgatcggcggtttcagaatgtttgaggaaagctatgtgctttggcagaataattccccgggcaatatcggcctcacgcttgtcggttatttatatcagcaggggcttgcatacaacgaaatggggtacggggcagcaatc

SEQ ID NO: 7 - DNA, 1000000 bp, Bacillus amyloliquefaciens
ggaattgtccttttgcttgtcatcttactagtcagccttgtttcactgaaactgtccggttcgtttaaaggggagggataagcgttgcgtaacaatcacatgttttccgtgtacagagtcgcgtttaccttgttttttatcatgctgagcctgttgtatatctttccgatgatctgtctattgctcggttcattaaagccgtcatctgagctgatgcgcatcgggctgaatctgcgtcttgatccggatgtgatgagccttgataactacacctatttgttcaacggggggagcatttattttaaatggttttttaacagcctgctgctcggcgtcctcaccacggttctcacgctgtttttttcctctttgatcggctacggactcggtgtctacgagtttaaaggcagaaatattattttcgttcttgtgctgatcattatgatggtgcctcttgaagtgatgatgctcccgttgttcaaattgacggtgggtcttcatttaatcgattcttatacgggggtgattctgccgtttattgtgtcgcctgtcgccgtgttctttttccggcaatatgcgctcggacttccgaaggatcttcttgattcagcgagaatggacggctgcaccgaattcggcattttcttcagaattatggcgccgctcatgaaaccggcattcggagcaatgatcattcttcaatctttaaacagctggaataactttttatggccgctgatcgtgcttcggtcgaaagaaatgtttacgcttccaatcggactttcagggctgctgagtccgtacggcaacaactatgacatgctgatttccgggtccgtttttgcgatactgccggtgatcatcatattcttgttttttcaaaaatacttcatttccggcctcacagtaggcggagtgaagggatagagagagggaggaaatgtaatgaaaaaagcggggattacagcagataaagaatatatcatcggtgaagtggacaaacggatgtacggatcttttatagaacatatgggccgggcggtgtatgaaggcatttatgagcccggacacccgaaagccgacaaggacggtttcagaacagacgtgcaggagttaatcaaggaattgcaagtgccgttcatccgctatccgggagggaattttctctcaggctacaattgggaggacggcgtcgggccggtgaagaaccgcccgcggaggcttgatttggcatggcagacgacagaaacgaacgaagtggggacgaatgaatttttaacgtgggcgaaaaaagtgaacgccgaagtgaatatggcggtcaatctcgggacgagaggaatcgatgccgcccggaacctcgtcgaatactgcaaccatcctgaagggtcatactggagcgacttacgaaaatcgcacggatatgaaaaaccttacggcatcaaaacatggtgcttaggaaatgagatggacggcccttggcagatcggtcataaaacggcgcatgaatacggacggcttgccgctgaaacagcaaaggtgatgaaatggacggacccgacgatcgaattggtggcttgcggaagctcaaacagcggcatgccgtccttcatcgagtgggaggccgaggtgcttgagcatacgtacgagcatgtggattacatttcactgcatacgtattacggcaaccatgaaaatgatcttgagaactatttggcgaagtctatggatttagaccattttattaaatccgtcacagccgtatgtgattatatgaaagcgaaaaaacgcagcaaaaaaacgattcacctttctttagatgaatggaatgtgtggtatcactcaaatgaagcggataaaaaagtggagccatggattacggcccggccgattctcgaagacatctacaattttgaagatgcgctgttgatcggttcactgctgattacgatgctgcagcatgcggacagactgaagatcgcctgtctcgcccagcttgtcaacgtgattgcgcctatcatgactgaaaagggcggagaagcatggaggcagccgatcttttacccttacatgcacgcctcagtctacgggagagggacttcgatgaagctgctgatcacctccccgaaatacgactcggcggactttacggatgtgccgtatgttgatgccgcggccgtttaccatgaagaggatgaagcactgaccatttttgccgtcaacaaaagcaaggaaccgatggaaacggagatcaaactgagggggtttgaagattaccgcatcattgagcatatcgtgctggagcatcaggatatgaaagcaaccaatcaaaaaaacagaaaagaagtcattcctcactccaacggaacgtcttcggcaaacgctgaagggataacggcacattttactccgctgtcctggaatgtcatccgtttatcaggaaaataatgttccgaaaagccgggctgccgctgccggcttttttttacgcaaaaatcatctcctgttatctgataattatgataatatttagaaaaagagaaaaggggctgggattaaatgaatgcgattacaatcgtcatagcgtctatatgtattttggcgatcgcctatcggctttacggtacctttatgatggtcaaagtattaaaaatcaatgatcagacaccgactccggcccatgtgcttgaggatgggaaagattatgtgcccacgaataagtgggtgtcattcggccaccacttcgcggcaatcgccgctgccggcccgcttgtcggaccgattctggcagctcagtttggctatctgcccgggcttttatggctgttaatcggagcggtgatcgggggagccgtgcacgatattgtcgtattgtttgcatcaatgcggaaaaacgggaaaacgctttctgaagtcgccaaagaagagctcggcccggtggcgggcttttgcaccggtctttccatgctgtttatcattacgatcacgatggcgggtctgtccatggttgtgctgcacgcgcttgagaaaaacccgtggggaacgtttgcggtggggattacgattccgatcgcgatgggggtcggcctctactataaaaaaacgggcaatctcaaactcgcatcaactgtcgggtttcttttgttaatggccggtgttgtaatcgggccgcggctgcagacaacggctctcggggacatgctgacacttgatgcgaaaacgcttgcagtggcgcttcccgtctatgcgtttttcgccgcggcgcttccggtttggcttttgctggctccgcgtgactatttaagcagttttatgaaaatcggggtttttgccgctttgatcgcaggcgtctttttcgtcaatcccgccattaaattcccggccgtaacggagtttattcacggcggagggccggtgatcgcgggtcctgtctggccgtttatttcaataacgattgcctgcggcgccatttcgggctttcatgcatttgtcggttctggcacaacgccgaaaatgctggataaatggagtgatataaaaccggttgctttcggagcgatgcttgtggaatgtctcgtcggaattatggcgctcattgcagctgccgctcttgagcccgccgactattttgccattaacagcacgcctgaaatattccgcgccctcgggatgaatgtcgtccatctgcctgaattgagtaaagaaatcgggctcagtctggaaggaagaacgggcggagccgttacgcttgccgtcggaatgacgtatatctttacggagattccgtttttcagtcatttggcttcatacttttttcaattcgtcattatgtttgaagcggtgtttattttaacggcgattgatgcgggaacccgtgtcgcccggtacttgattcaagagtttttcggagaggtctataagccgctgaaaaaaacagactggctgccgggctcgattttctcaagcgcgctcgcctgcctgctgtggggctatcttctgtattcgggcgacatcagttccatttgggcgctgttcggcgtatccaatcagcttatggcatctgtcggcttaatcatcggtgcgaccgtcgtattaaaaatagcggataagcggcgctatatgctgacatgcctgattcctctcgcttatttgtacgtgaccgtcaactatgcgggttattggatggtgcggtatgtgtatttgaaccccgaagcggcgggatacaacgtgctgaatggcgttttatccattatcatgctgattctcgggcttgtgattatcattgcggctgtgaaaaaatgggcgaatgtatggcgtgatccgagtgccagactggaagcttcaatacccggataaatccgcggccgatccgaacattgtagcatcataaaggcagagagccgatcggtctctctgctttcggcttatgacaaatccgccgcttccaaaaggtaatccgccaaatgaaccgcgcggacacggcctgttaatccttcgcgtaaaatgccgagctgcatttgcagaaggcatccgggattggctgtcacgatgacggccgcctccgtttttccggcggctttcatcttgctgtctaatattttcatagacatttctgactctgttatattataaattcccgccgacccgcagcagctgtcggccttttccatttctctgtactcagcccctttaatgtttttcaaaagcgtgcgcggttcttctgacgtatgcatcacattgcggagatggcaggagtcctgatatgtgacgatatgaggagactgcgcccgcaggtttttttgatggaacttcagatcaaccagtacggatgaaaagtctttgagcttccggacgaattgttcggcacgttccgcccatccaggttcatctttcagtaaatgcggatattcctgaagaaaggcgccgcatccgccggcgtttgtaatgatataatcagcgtcaagcgcctcaaaagcggcgatattccgcttggccagttcttttcccatctctttttctccgctgtgcccgtgaagcgcgccgcagcacgcctggccgtccggaaccgcgatttcacacccggccgcctgtaaaagcgccgttgtcgcatgatttgttgctaaaaacatcgtatccattaagcagcccgagaaaaaagcggcccgtttttggacgggacccgcggcaggaagaaaacgcggcctttccttcatgtctttccgtttcggggcgggcgggagcacttgttccattgtgcgcagatgttcaggcaaaacgcgcagcataccggtttttctgatggcggtctgcagtcccgatctttggtatattccgagaagattcacggctgcctgcatgcggttttgatgagggaaaagcccggtgaaggcggctttccgcaagaggcgcacgccgggcttatgttttttattttgatgaatgatatccctcgcttcttcaagcagctgtccgtaattgacccctgccggacaaacgggctcgcatgcccggcatccgagacacagcgaaagtgagcgctcgacatcttcatccggttcgatcagtccgtctgtgacggctttcatcagggcgatccggccgcgcggcgaatgggattcttgaaatcctgattcgatataggtcggacaggaaggaaggcagaagccgcagcgcatacagttcagcaattcaccttcatccatgcggtttttgaattctgtttgaatgtgttgctgctctttagccgttgtcatttcatcatcaccacgcgtttccttgatgaattggcgaatatttttcccggattcagcagattttggggatcaagcgcttgtttgatcgctttcatggcggtaatgccttctgttttcagcttcatttctaaatacggcgcttttacgatgccgaccccgtgttcacccgttatcgtcccgcccagctcaatcgctttttcaaaaatggcggcaaaagctttttcgacacgttccatctcctctgtatttcggatatcggtggtgcacgtcggatggaggttgccgtctccggcatggccgaatgtgcagatggacaggccgtatgtttctgcaatctcgttaatggctttgaccatgccggcaatttgtgatctcggcacggtcgcgtcttccagaatcgtcgtcggtttcagccgggcaagggctgataatgcggaccgtctggcctctgtaagcgcgaatgcctcttcctcggtttcggccgtttggacggatacggctgctccgtttttacagatggcttcgattttttccatatctcgtctgaccgtttcgatgtcaccgtcctgttcgatcagcagcaccgcttttgcatcggtcggaagcccgatcttggcgtaatcttcaatgacctgcagtgtcggctgatccagaaattcgagtgtcgccggaatgattttttcagcgatgatggcagaaacagattccgcagccgcttcaatatgttcatagagtgcaagcagcgtttttttcgtttccggcttcggaaccagctttaaagtcgcttccgtcacaacgccgagcgtaccttctgatccgacgaaaagccgggtcagatcataaccggcgacatcctttgtcagcttccctcctgtgcggatgatatcgcctgaagccaagacggcttcaaggccgaggacataatcccgggtgacgccgtacttcaaaccgcgcagcccgccggaattttcattaatattcccgccgatcgtcgatattttcatgctgctcggatcaggcggataaaataaccctttcctttcaaccgcatgaatcatatcttgcgtgatcacgcccggctggacggttgccgtcaaattttcttcatcgatttcaagaatgcggttcatatgtttgaataaaagcacaagcccgccttcagacggacatgtgccgccgcataagtttgtgcctgaacccctcggcacgatcggaatgtcatgcctgctgcaaatcgttaatatacgggacacgtcatccgcgctgcggggagcgattaccgcatccggcatggcttgcagctgaggagccgcatcgtaagaatacacaagacggccagccgccgaatcatcataattctccttcccgaccgtccggatgaacgcttcttttgcctctcgtgaaatcatgttctccaacctccctgataagaaaagcgttttcatttaattgtaaagaaaaacgattcttcacactatggagaaacatatgaaaaatgatgatatgattacgtgctttttgtatgttgatctaaaaagcggagcgccaaataaaaagccgttatgtcttcggggcggtcaagcttcatatttgtcagtgattccagtttggaaagacggtagcgcaatgtattgatatgaatatgcatgtcgtctgcggtgcgctttaacgataattgccggtcgaaaaaggcgcgcagcgtatccagaagttcttcccggccgagtacatgctcgagaacccgccgtgaaaattccgacctcgtgccgggcgcgatatcggcaatacacatatccagttttaaatcttcttcaaagacggcctgcttgtcaccgattccggctgaaagtgctttatccgcctgttcgtatgattccgcgaggcgctctcccggaacgatccgtccgatgccggcggtgacaggctgcccaaaaacggcgccgatctttttgatgagctgtgttttggaagccgaatttgcttcatggttaatgagaatgcgttcatttccccagcggacaaacaggtcttcagggcattcgttctgccagagccgcccgagctcctccgctttatattgctcataacgtccttgaatgagtatgatccggcggtatgcgtgaaggtctgcgccgatgagctttgctttttctaaaaagcccggagaccattctttcagctgcagccaatcaaccataaaggattcaagcattctcgcacgccactgcgcttcttccatatggcgcgtttctttaataaacagctccgtcattttcctgagcaattctccgaaaggcaggatatcgtcagggtctcctgtcagaccgaacactccgattacctcatggcctgaaaaaacggggaggttcagtcctgcttttacgccctggaggcgtttttcatcttctttcgtaatgatgacattccgtttttcgcgggcgcagatcagtgcgccttcatgaaaccatccggcgcgcgcctcattggtgcccgcgatgatcatcccttttgtatcggcaataatcacttcgcggctgtacatatgtttgacttcggcaatcaatttctttgccagttccggctgtaactgcatggcgatccccctcgccattattatacaaaaaaaaccgggtgtgccatcacccggttcatgcttattgcgcaggttttaatccgccttcaagtgttttgagcatttcatttttttctgagtctgacgcatgctgccaaagaacttcgaataagacgccgaggcccggaagcattttttcttcaccgctttggatggcgtcaacgatagtatgctccagctgatcctggttattgccggttacattggcaataacggcgttgcgtaaattaagatccattacaaccgctcctttttcctgaatgtgatacgcatattcttaccgcgcacgcggtttattatgtgctgttcttgagatataataacaacatgcatgaaaaaaggagagcacagacataaagtgaaacgaatcgactctgcaaaaaaccaaaaagtgaaggactggaaaaaacttcacacaaaaaaagagagacttaaaacgaatacatttctgatagaaggagagcatctggcagaagaagcgctcaaatcaaagggaacggtaaaagaaattctcgtaaacgatgagagcgccattccggccgatctggatatgagcattccgtgctacgtgctgagcgaagacgcgttttcagccgtgacggaaacggaaacgccgcagcggatcgccgcggtctgccatatgccggataagcggcctgatcagctgaagcggctgcttctgattgatgccgtacaggacccggggaatttaggaacaatgatcagaacggcagatgcggcgggaatcgacgccgttgtccttggtgagggaacggcagacccgtacaacggaaaaacgctgcgttcagcgcaaggatctcattttcatattcccattttaaaacgtccgcttgatgagtttaccgccgagctgaaatcacaaggcgtcgcgatctacggcacggcgcttgaaaacggtgcggcttatcaaagcgtgaagcctgaagaatcgttcgcgttaatcgtcgggaacgagggggcgggagtggacgccggccttctgcaaaaaaccgatctcaatctgtacgttccgctgtacggacaggcggaatcgctgaatgtggcggtagcggccgccatcctcgtttatcatctcagaggataggttgcgaaaaaccttggatttcactataatagatagcaataatgtaaaaaccgtgacagaggacgtcaatttttgcacacgctgccttccagggagaaaatgccgctgactgagagcatttttatcgcagcacagaaattgattttcacctctcgagttgtcaccgggaccgcgccaaacgcgcgtaaaggtgaaccggaacgatcgtttccgttatgtcaatgaagctgtcggcagatgaagtctgccttaaaaagggtggtaccgcggccacaactcgtcccttctctcaaggggcgggtttttttgttttctgaaaaaggcatagaacggtttggtttacataaaaggaggatgcatgatggaagagaagcttaaacagctcgaactggaagctgcagaaaaagtagaagcggcgggttcattaaaagaagttaacgacattcgggtgcaatatctcggaaaaaaagggccgattacagaagttctccgcggcatgggcaaactgtccgccgaagagcgcccgaaaatgggagcgctcgccaatgaagtgagagagcgcattgcagcagccattacggcgaaaaatgaacagcttgaacaagaagagatgaataaaaaactcagcagccagacgattgacgtcacgttgccgggcagtcaggtaaacatcgggggacgccatccgctgacggtcgttattgaagaaattgaagatttatttatcggcatgggatataccgtcgaagaaggccctgaagtggaaacggattattacaactttgaggcgctgaacctgccgaaggaacatccggcccgcgacatgcaggacagcttttacattacagaagaaatgctgatgagaacgcagacgtcaccggtgcagacgcgaacgatggaaaagcataaaggaaaaggccccgtcaaaatcatttgtcccggtaaagtgtatcgccgcgacaacgatgacgcgacacattcccatcagttcatgcagatcgagggtctcgtcgtggaccgcaaaatcagcatgagcgacctgaaaggcacgcttgaattggtcgccaaaaaaatgttcggccaagaccgtgaaatcaggctccgtccgagctttttcccgttcacagagccttctgtcgaggtggatgtgacctgctttaagtgcggcggacaaggctgctccgtctgcaaaaaaacaggctggatcgaaattctcggcgccggcatggttcacccgaacgtgctgaagatggccggattcaatcctgaggaataccagggttttgctttcggaatgggtgtggaacgtatcgcgatgctgaaatacggcattgaagatatccgccatttctataccaatgatgtcagattcatttcgcagtttaaacaggcgtaagaggaggatacacatgtttgtttcatataaatggttagaagattacgttgacttgcagggaatcgacccggccgtgcttgcagaaaaaattacgagagccggtattgaagttgagggtatcgagtataaaggggagggcgtaaaaggcgttgtcatcggacacgtgcttgagcgtgaacagcatccgaatgccgacaaactcaacaaatgccttgttgatatcggtgcggaggaacccgtgcagattatctgcggcgccccgaatgttgataaaggacagaaggttgccgttgcaacggtcggagccgtgcttcccggcaatttcaaaattaaaaaagccaagctgcgcggcgaagcgtctcacggcatgatctgttcccttcaggagctcggcattgaaagcaagctcgtggcgaaagaatatgcggaaggcattttcgtttttccgaatgatgctgaaacgggagctgacgcaatggcggcccttcagcttgatgatgcgattttagaattcggcttaacgccgaaccgcgccgacgcgatgaacatgcttggcgtggcttatgaagtggcggctatcctcggcgcagaggtaaagcttccggaggcttcatatgaaaaagcggcagaaaaagcggcggatgctgtttccgtcaagattgaagatacgcaggccaatccgcattatgccgcaaaaatcattaaaaacgtcaaaatcggcccgtcaccgctttggatgcagacgaagctgatgaatgcaggcatccgcccgcataataacgtcgtggacattacaaacttcgtcctccttgagtacggacagccgcttcacgctttcgattacgaccggttcggttcaaaagaggtcgtcgtcagaaaagcggcggaaaacgaaaccatcgtgacgctggatgaacaagagcgcaagctgtcaagcagccatttggtcatcacaaacggaaaaaaagcgcaagccgttgcgggagtcatgggcggagccgagtctgaagtccgtgaagacaccactgcgattttactggaagccgcttatttcgacggacagaccgtccgcaaagcgtcgagagacctcggactgagaagcgaagcgagcgccagatatgaaaaaggcattgatccggcccgcgttttgctggcggctgaacgggcctgcagtctcattcaggcatatgccggcggagaagtgctctcaggcacggttgaagaaaaccatctgaaaatcgaagcaaacaacattcacgtgtctgttgaaaaagtgaacgccgtgcttggcatggcaatcgctaaagaagaaatcatcagcatttacaagcgcctcgggtttgcagtcagtgaagctgaagacgttctcgtcgtaacagtgccgtcccgccgcggagatattagaatagaagaagacctgattgaagaagcggcgagattgtacgggtatgacaatattccgtccacgcttccggaaacggccggcacgacaggcggcttgacaccgtatcaggcaaaacgccggaaagtgagacgtttccttgaaggagcgggtctttcacaagcgaccacttattcattaacgaatgataaaaaagcggccgcttttgcgatcgaaaaatcattcaacacgatgcttgctctgccgatgagcgaagaaagaagcattctcagacacagtctcgtgccgaatcttcttgaagccgtttcatacaatctggccagacagactgattccgttgctttatatgaaacgggttctgtatttctgacgaaagaagaaaacacaaaaccggttgaaaaagaacgggttgccggagctgtaaccggattgtggcgcaaaaatttatggcagggtgagaaaaagccggttgatttcttcgtcgccaaaggaatcgttgaaggcctgctgcatcaattgaatgtgtcagatcgggttgaatttgtccagtctgcacgcaaaaacatgcatcccggccggacggcaaacattctattgaacggttcgcttgccggatttatcggccaggtgcatccggcaatggaaaaagagctggatatcaaagaaacgtatgtgttcgagcttgatctgcacgcgcttctgaccgaggaaacagaacctgtcgtgtatacgccgattccgaagtacccgtccgtcacgcgcgacattgcgcttgtggcagataaaaccgttacaagcggacagctcgaagccgtgatcaaagaagccggcggcgcgctgctgaaagaagtcaccgtatttgatgtgtacgaaggtgagcatatggaagagggcaaaaaatccgtcgccttctcgctccaatatgttaaccctgaacaaacattgacagaagaagaagtgacaaaagtacatgaaaacgtgctgaaagcgctggaagaaacgtatcaggcggtattaagaggataaagaaaaagcttgcagatcattctgcaagctttttttattatgaccgtttccgttctacaaggcgtttcgctttttgcgtattggcaaaatgaagtttggtgaacgttctgagcgcaccttctcccttattgatgatcagcttggcggcagcttcatcgacgtgcggccccgcgccttttggaatcgtcatcccagcctcacgggaaagcttatccatttcaattaagaaagaatatcgcgcaatgatagaggctgcggcgacggaaagatgtatgctttccgctttcgtgctgaaaaacgttttttcttttacgatatcccgtccggaaagatgcttaaaataaatgccgggctctgcaaattggtcaatcagaatcgcttccggtttaacgccgttcatttttctcagcagattggaaatcgcctgattatgaaggagcgccttcatttttccttggctcatgcctttttcctgcatctgattgtatttttcgtttttcaacacaagcaggctgtaaggaatggttttaattaacagtttggcgatttcaataatctgcggatcttttaaatccttcgaatccttcacaccgagttctttcattaaagaaagctttgttttgtcggcgtaagcgcaggcaaccgttatcggcccgaagtaatcgcctgttccgacttcatcagagccgatcactgacatggaggcaatgcccgccgggggagcgtaaagcggatcggccgcttttttgacggttttctttgccttcggcgcctcagccgttccccagcgggccgcttctgtgccggcgttttttccctgaaagagaaccttgcccgagcggtaggctgtaatggtacagcccgggggcttggcctggaagacggcgccctgcggaacggcgggagtaagggagccggcataggattgtttcatttgttccatagcggaagcggatacttttataacagaatgggacacgatataatctccttttttggcacttttcactgtatataccagtgtatcataacagcccgaggcttgtctttccattcaaacgataatcgtggtatgataggaactaggattctcgcggaatggaggagaaacgttgtctgacggcaaaaaaaccaaaacgacagtaaacatttacggccagcacttcaccattatcggggaagaaagcaaagcgcacatgcgccatgtggccggaatggttgatgataaaatgagagaaatcaacgagaaaaatccatatcttgatataaataagctcgctgtattgactgcggtcaatgtcgtgcatgattatatgaaactgcaagaaaaatatgaaatactggagcggcagcttaaagaaaaggaatgaacaccatatgatagatatcatcatcttagttctgctcttaatgggcacattgcttggattaaaaagaggatttatcctccaatttatatacttgacgagtttcatcctctcgattgcgtttgcggcgcttttttacaaaaacctggccccgcatctgagctttatacccgcccctgatttttccggcgggcaggcggctctgtcttttattaaaggaaacgtggagacggcttattacaacgcgatcgcgtttgtcattttgtttatcatcgcaaagatcctgctccggattatcggagcggcgcttaatatcatcgccggcattccggtcattaaacagatcaacaaactgctgggcggggtgcttggatttctggaagtctatttatttgcgtttatcctgttatacgtcgcatccgtactgccggtaagcgtgcttcaggatatgctcgcacaatcgacgcttgcaaatatcatcacacatcatacgccgtatctgtcggggctcctgcaagaactgtgggcccagtacggggcataaaaaacttctcttgaccggagaagtttttttcaagctctgcgtcagttgtgccggaagagaaaaatttgtatgatgaaaagcaggaaacgactgggggttaacagtatgcataaaaaagatatcatcaggctgcttgaaacgattgcggtctatatggaactgaaaggggacaacccgtttaaaatatcagccttccgaaaagcggcggcggcgcttgagcaggatgaccgcagcctgtcggaaatcgacgacatgatgtctttatccggaatcggaaaaggcacctacggcgtcattcgtgaatatatgcaggaaggtgtgtccggcacgcttctccaattgcagaaagaagtcccggaaggcttggttcctcttttgaagcttccgggcctcggcggcaaaaaaatcgccaagctgtaccaggagcttggcgttcatgacgcggaatcgctgaaagaagcatgcgagcagcaaaaagtacaggggctcgccggtttcggcaaaaaaacggaggagaaaatccttcaggctctcggagaagccggaaaacagccggaacggtttccgatcggctatgcgctcagcattgcttcagtcattgaagaacatttggcccggctgacggatattcagaaatattcccgggccggcagtctcagaagagcgcgggaaaccgtaaaagatctggattacattatcgctacagatcgtccggaggctgtcagagaacagcttctttccctcccgaacgtaaaagacgtgatagcgggcggggatacaaaagtatcggttatcctgacctttgaatacgagacgagtgtggatttccggcttgtgacagaggaacagtttgccaccacactgcatcattttaccggttctaaagatcacaacattaaaatgcgtcagctggcgaaagagcgcggtgaacggatcagtgaatacggagtagaaaccatagaaacgggagacgtcaaaacattcccgagcgaagaagcgttttacgcccacttcggtctgccgtttattcctcctgagctcagagaaagcgggcaggaggtcgacacgtaccgggaagaaacggaccttgtggagcataaagcgataaaaggcgatctccacatgcactcagcctggagtgacggcgctttttccatcagagaaatggcagaagcgtgtatggcaaaaggctaccagtacatggcgatcaccgaccattcccaatatttaaaggtagccaacgggttaacggccgaacggctcagaaaacaggcggaagaaattgacgcgttaaacgctgaatttgaaaattttcatatttttaaaggcgtagaaatggacattctccccgacggttcgcttgattatgatgacagcgttctgtctgaaatggatcttgtcatcgcatctattcattcaagcttcagccagccggagcatgtcattatgaaacggcttgaacaggcgctgacgaataagcacgtggacattatcgcccacccgacgggacgcctgatcggcagacgggccggctatgaagtcgacatcgacatgctgattgagctcgcagccaaaacaaatacggcgcttgaactgaatgcaaaccccgcgcgcctcgatttacggactgagcatctgatcaaagcaaatgaaaaaggtgtgactttggtcattaataccgatgcccataatatcgagatgctcgatgatatgaaaacgggcgtgaccgctgcgcgcaaaggctggacagagacaaaacatgtgttaaacgcccggccgttacatgaggtcaaagcatttctgacgcgcaatgattaagtaaggaggaccataaaaccgtgcagcaaaaagtgttatcatcacttgaatttcataaagtaaaagaacagattaccgcacatgccgcctcatcgctcggcagggagaagcttctgcagctgaaacctttgacggatctcgccgacatccaaaaacagctggatgaagtcgaagaagcatccgcggtcatgcgcttgcgaggccatgctccgttcggcggcctgaccgacataagatccgctttacggcgggcggaaatcggcagtgtgctgacgccggcggaattcaccgaattgtccgggctgctgtatgccgttaaacaaatgaagcattttatcagccaaatgacagaagacggcgtcggcataccgctgatacaggcccatgcagaagagctgattacattaggcgatttggaaagggagattaactcctgcattgatgaccatggtgaagtgcttgatcatgcgtctcccgctttaaggggaatccgcacgcagctcaggacgcttgaatcaagagtcagagaccggcttgaatcgatgctgcgttcatcttccgcttctaaaatgctgtctgacaccatcgttacgattcggaatgaccgctttgtcatcccggtcaaacaggaatacagatcaagctacggcggaattgtccacgatacatcttcatccggtgctacactgtttattgaaccgcaggcgatcgtagatatgaacaactcgcttcagcaggcgaaagtaaaagaaaaacaggaaatcgaacggattctccggatgctgacggagcatacggctgaacacacacaagaaatcgctcaaaatgtggaagtgctgcagacactggatttcattttcgccaaggcgagatacgcaaaagcaatgaaggcgacaaaaccattcatgaacggagacggctttatccgtctgaaaaaagcgcgccatccgctgctgccccaagatcaagtcgtggccaacgatattgaactgggcggagattattcaacgatcgtcatcacgggaccgaatacgggcggtaaaaccgttacgttaaaaacactcgggctgctgacgataatggcgcaggcaggattgcacataccggctgacgagggctcggaagcagccgtatttgacaatgtgtttgccgatatcggcgatgaacagtcgatcgaacaaagtctgagtacgttctcatctcacatggtcaatatcgtcaatattttaaaagacgtgtctgaaaacagtcttgtgctgtttgacgaactcggtgccggaacagatccgcaggaaggggcggcgcttgccatgagcatccttgacgaagttcaccggacaaacgccagagtgcttgcgacaacccattatccggaactgaaagcatacggatataacagacaaggcgtcatgaatgccagcgttgaatttgacattgaaacgctttcgcctacctataaacttctgatcggagtgccgggccgaagcaacgcatttgaaatctcaagacgccttgggcttccggagcatatcatcggccaggcgaagtcagaaatgaccgccgaacataacgaagtcgatctgatgatcgcatcgcttgaaaaaagcaaaaaaagagcggatgaagaactttctgaaaccgaatcactcagaaaagaagcagaaaaactgcacaaagagcttcagcagcaaatcattgagctgaatgcccaaaaagataaaatgatggaagaagccgagcggaaagctgcggaaaaactggaagccgccgcaaatgaagccgaacagattatccgcgagctcaggtccatcaagcaagaacacagatcctttaaggaacacgagctgattgacgccaaaaaacgtctcggagacgcgatgccggcttttgaaaaatcaaagcagccggaaagaaaaacagagaaaaaacgcgagctgaagccgggcgacgaagtaaaggtgctcacattcggacaaaaaggggcgctgcttgaaaaaaccggcgagaaagaatggaacgtccaaatcggcatccttaaaatgaaggtgaaggaaaaagatcttgagtttctcaaatcggctcctgaaccgaaaaaagaaaaagcaatcaccgccgtaaaagggaaggattatcacgtatcccttgaacttgacctcaggggagagcgttacgaaaacgccctcagccgcgtcgaaaaatatttagatgacgcggtgctcgccggctatccgagagtgtccatcattcacggaaaaggcacgggcgccctccgaaaaggggtgcaggatcttctgaaaaaccaccgcagcgtgaaaagctcgcggttcggggaagcgggagaaggaggatcaggcgtaacgattgtcgaactaaaataaaaagggagaaaacgtcatgaatgctttttgggaaaatgagcttgttgaaatcgcggcttattacagtgttgccgtcttgtgtctcgtcatttttctgaccgtgtttgaattggtgacatcctataaaaactgggtggaaatccaaaaaggcaatcttgcggtggcaatggcgaccggagggaaaattctcggtatcgcaaatgtctttcagcacagcatcgcccagcataattcgcttttgcaaatgatcggctggggcgtatacggatttattatgcttttaatcagctattttatctttgaatttctgacgccccggtttaaaattgataaagaaattgaaaaagataacagagctgtcggctttatttcatttgtcatctcagtcggcctgtcatttgtggtggccgccgggatttaaggggacggggaaaaatggagaagcttgcgaaagtgctgctgtcggcagcggggatttttctgttcatcggacttatttatctggtcatgacatcttaatactgaaaaaaggctgccgaactcaaatcggcggccttttttattgagaataccagtttatgcaggccgtatcagagcaaatgacggcttcccaattcatggcgcggacgacagactgaatgtcttgttcttccatgagaaagagtgtcgtaaaagaatcatatatgctcataaaagcggcgcgccgttttttcatcggcaatgatcatgtcagcccgcagcagtccgcatacatccgaagccgccgtttgattgagtgaaaataggcctttctcttcgacaggctcataataagtgcagcgctttatgccttttgaacggaacacatccaaaagtcccggaatcaaaaatggcgaagtgacatcatcgctcggcaagtacagatcgggatgatggagccgatttaaccgctcggcggattcaggatgtgcatattcctcccgcaatgccgtgacagcagtcataagcgcaagcgccgtttctttttcagaacgcaggccgcaaatgctcatgacggtttgccaggaaacgggtctgcccatcgcgatgatctcctcatcactcggatacatatgttcataaggccgtttgcgcttttgctcttcccgaccatctggcatccggacaaagggatggagcaaaaaggcggccgacgtaatcggcttcggcagctggcgcaggataggaactcccccttcaaaatgcagcgtttccagaaaactcaacacctcctgaaactcgaaatttcccatgaaacgctttcccattccaatcacccttctgctataataatagcgtataggaaaacagaagggagaggtattatgcagtctgaaaagccatggctttctcaatatcccgaagagattccgcatgagcttgaatttaccgatcaaaccctgccatccaatctgacaaactccgcagctcaattcccgaaccataccgccatttattttctaggaaaaaaactcacattccaagacgttctcacagattcattaaagcttgccgcttttttacgcaaaacaggcctgaaaaaaggtgacagagccgccattatgctgcccaattgtccgcagtcggtcatcgctttttacggcgtattgtttgccggcggcattgtcgttcagaccaatcctctctacacggaacacgagcttgagtatcagctgaaagacagtgcgccgcgcgtgatcatcaccctcgatatgctgtttccgaaagtgataaaaatgaaaacgttatcactcgtcgaacgcattattacaacaagtataaaagactttttgccgtttccgaaaaatatgctttatacgctcacgcaaaagcaacaggtgcatattgattatgacggctgcgaacaaattcacaaattagcggatattttaaaaaacgaaaaagcagaggaagcagagccatttgatattgaccctgcgcatgacatcgccgtgcttcaatacacgggcggaacaaccggctatccgaaaggcgtcatgctcacacaccgaaacattcaggccaatacagaaatgtgcgccgcctggatgtacaaaatgaaaaagggagccgaaaaggtgctcggcatcgtgcctttttttcatgtgtacggattgaccgccgtgctcaatttttccattatgcagggatgtgaaatgatccttcttcctaaattcaatcctttggatacactgaaaacaatcgacaggttgaagccgacggttttccccggggcgccgacgatttacatcgggctgctgcatcacccggagctgaataagtatgatctgtcctccattgaaagctgtccgagcggttcagcggcactgccggttgaggtcaaacagaaatttgaaaaagtgaccggaggaaagcttgtggaaggctacggattatccgaagcatcaccggttacccattcaaacttcatctggggaaaaaataaacccggcagcatcggctgtccctggcccaataccgatgcgggaatctattcagaagaaaaaggcgggcttgcggagccgtatgaacacggcgagctgatcgtaaaaggccctcaggtcatgaaaggctattggaataagcaggaggagacggcgcgtgtcatcagagacggctggctgtttaccggagatatgggatatatggatgaggaaggatttttctacatcgccgacaggaaaaaagacatcatcattgccggcggatacaacatttacccccgcgaggtggaggaggcgctttatgagcatgaagccgttcaggaaatcgtggtagcgggcgtccctgattcctacagaggggaaacggtgaaagcatttatcgttttgaaaaaaggcgccgaggcagatgccgatgagcttgatgcgtttgcaagagagcggcttgcgccgtacaaagtcccgaagctgtacgaattcagaaaagagcttccgaaaacggccgtcggaaaaatattaagaaggcgtttagtcgaagaggaagatgcttcccatgaaaacaaggtgccttaaaagaaaaacttgacaaaatccggattcctttttatcatgaagttatgaatgaatagtcattcatttatcgaaggaaggaacgatgacattgaaccaaaaacggccaaagtatatgcagattattgatgcagcagtagaagtcatagcggaaaacggctatcaccaatcacaggtgtccaaaatcgccaagcaggccggcgttgcggacggcaccatctatttatatttcaaaaacaaagaggatatactcatttctctttttaaagaaaagatgggccagttcattgaacgcatggaagaagaagtgaaagaaaaaacgacggcaaaagaaaaactcgctctcgttattaagcagcatttcacactgctcggcaatgaccgccacctcgcgattgtgacccagcttgagctcagacagtcgaatatcaagctgcgtctgaaaatcaatgatattttaaaaggttatttaaacatgctggacaccattttgaccgaaggaatcgagtcgggcgaatggaaagataatctcgacgtccgcctcgcccggcagatgatattcgggacgatagatgaaacagtgacaacatgggtgatgaacgatcagaaatatgatcttccggatttgtcagacaaggtattggagctgttggtgtcagggattcatcaaaactaaagggggttgacggatgaacagcctttcgatggcggtagaacaatctgttgcggtgatcaccattaatcatcagccggcaaacgcgctgtccggcgcggttttagatgagttgtccggtctgttcgaccgctgtgaaacagatgacagtgtcagaagcatcatcattcgcggagaggggaaatttttctcggcgggcgctgatataaaggaatttacgtcgcttgaaaatcttgagcaatcttctgccatggcggataaaggccagcagctgatggaaagaattgaagggtttccgaagcccgttatcgcagcgattcacggcgctgcgctcggcggcggccttgagcttgccatggcctgccatatcagaatcgctacattagatgcaaagctcggcctgcccgagctgaatctcggcattattccgggctttgccgggacgcagcggcttccccggtacgtcggtacggcgaaagcgcttgaaatgatcggcacttcagaacctgtaaccggagaagaagcgctcagcctcggtcttgtcacgataggcgccgaacatgaggaagagctgctgcaaaaagcgaaaacgctcgcgggcaagtttgcggaaaaaagcccgcagtcgatggcttttctgcttgagctcctttattcaaacaaggtctattcttatgacggcggcttaaagcttgaagcaaagcgctttggggaagcatttgcatcagatgacgcaaaagaaggcattcaggcatttctcgaaaaaagaaagcctcaattcggtgggcgaagataaaggggataagaatatgaatctatttgtactgatgaaacggacgtttgacacagaagagaaaatcgtcattgaagcaggaaagattcaggaggacggggccgaatttatcattaatccgtatgatgaatacgccattgaagaagccattcagctgaaggaagagcacggcggaaccgtgaccgccgtaaccgtcggcggagaagatgcggagaaagaactgagaaccgcccttgcgatgggctgtgaccaggcggtgttaatcaatattgaagatgatctgagcgatcctgaccaatactccgtttcaactatcttatatcattatttcaaggaccgggaatatgatctgattctcggcggaaatgtcgcgattgacggcggttccggccaagtggctccaaggcttgccgaactgctgaacattccttgcgtcacaacgattacaaaactgacaatcagcggcgatgaagctgcggcagagaaagacaacgaaggggataccgaaatcattaaaacctcacttcctttagtcatcacggcacagcaaggcttaaacgagccgcgctatccgtcgcttccgggcattatgaaggcgaagaaaaaaccgctggaagaacttgagctcgatgatctcggcattgatgaagatgatgccgcaccgaagctcaaaacgatcgaacgttttctgccgccgcaaaaagaagcgggcagactgatcgaaggagaagcctctgagcaggcgaaggagcttgtatcactgctgagaaaagaagccaaagtcgtataaactgatattaaagaaactgggggatgtcagaatgggaaaaaaagtgatcgtactcggagaaattcgtgacggcgccttacggaacgtcacctttgaagccatagccgcaggcaaaaccatttccggcggaggagatgtcatcggcgtgctgatgggaaagggcgcggctgatgcagcatcagaactcattcagtacggcgccgacaaagtatttacggccgattcgccggggctttctcagtatacggcggacggatatgccgcaattctcggggatttgatcgaaaatgaaaagcctgatgcggtcattttcggccacacttctatgggaaaagatttgtcacctaagcttgcggcccggtttgaaacggggctgatttcagacagcacagatgtaagcgttaccggagataacatcgtttttacaagaccgatctattccggcaaagcctttgaacaggtgatttcaaccgatcctttcattctggcgacaattcgtccgaataatattcaggcattagaaaaagacgcgaaccggacgggtgatattgaagagcttgcggcgcctccggcagatttgcggacggtcattgaagaagtagtcaaaaaaacggcggacggcgtggatttatcagaagcgaaaattatcgtagcaggcggccgcggtgtaaaaagcaaagatggatttgaaccgttaaaagaacttgccgaggtgctcggagcagcggtgggcgcttcgcgcggcgcatgtgacgcggactactgcgactattctcttcaaatcggccagacgggaaaagtcgtcacgccggatttgtatatcgcctgcggaatttccggagcgattcagcatttggcgggcatgtcaaacagtaaggtcatcgttgccattaacaaagacccggaagcggaaatatttaaaatagcggactacggaattgtcggcgatttgttcgaagtggttccgcttctgactcaggaatttaaaaatgccaatattcattcataatcaaaaccctctggcttatttgtcagagggttttggtttgtgttaattagttcgtacaaattatagattaataaaacaacagattgacatgtacgaaccaatgtaataagcttttgtaaagcgcttacaaacttatccatacagcatacatcccagatagatcggctgtagtgctttcattcttattaaggggaaggaatgatcaagtttgtctcacaatacggcagtcattcaaactgatatcacacggggaaccattaataaaaacatatacggacatttcgcggaacacctgggaagaggcatatatgagggcatctgggtcggaaaagattccgatattccgaataccggaggggtcaggacggatgtcgccgccgccctcaagcagcttcagattcccgtcctcagatggccgggcggctgttttgctgatgaataccattgggcaaacggcgtagggaaacgcaaaacaatgctgaatacccattggggcgggacgattgattctaatgaattcggcacgcacgagtttatgatgctttgtgaactgctcggatgcgaaccgtacatcgccggtaacgtcggcagcggaacggttaaagaaatggctgattggattgaatacatgacgtttgaagcgggcacgccgatgtccgactggagaaaagaaaacgggcgggaaaaaccgtggaagctgaaatatttcggaataggaaatgagaactggggctgcggcggaaacatgcatcctgagtattatgctggcctttacagaaacttccaaacctatgtccgtaattacagcggtaatgaaatctataaaattgccggcggcgcgaatgtcgacgattaccgctggactgaaactttaatgaaaaaagccgcggatctcatagacggactgagcctgcattattacacaataccgggcgacttctggaaggggaaaggatcagcgacggagtttacggaagatgaatggttcatcacgatgaaaaaagcggcgcatatggatgaattgatcacaaggcacagcgccatcatggatcagtacgatcccgaaaaaagagtcgggctgatcattgatgaatggggcacgtggcttgatcctgagccgggcacaaatccgggctttctgtatcagcagaatacgatccgcgacgcccttgtcgccgccgcgcattttcacatttttcatcagcacgcagaccgcgtacagatggccaatatcgcgcaaaccgtcaacgtgcttcaggcaatgatcctgacagaagggaaagaaatgctgttgacgccgacgtatcatgtgttcgatatgtttaaggtgcaccaggacgcatctcttttggcggcagaaacaaatgcagccgggtacgaatggaatgacggccggctcccgcaagtcagcatttcagcgtccaaacagcagaacggagacatacatatcagcatttgcaatatcgatcatctgcacaaagctgacgtgaagattgaactgcggggcatgaaaaagacagggacgccttcgggaacgattctgcacgcggaaaaaatgaatgcccacaatacattcagcagtccggaaaacgtcaaaccgaagccgttttccgggtttgctcaaaagggaggaaaacttgaggcggagcttcctccgatggcgattgtattaatcacgctgcctgcaggtccatcttaagttttgaacgcccgccgcccggttataatacactgtataaataagattatttccggcgggttcgggggaaaataatataagcattaaattagcatgaacgaatgggagatgctatactaaaaatcatcatttgacaattggaggaataacaaatggctatcgtaaaagcaactgatcaatcgttctcagctgaaacaagtgaaggtgtcgtattggctgatttctgggctccttggtgcggaccttgtaaaatgatcgcgcccgttcttgaagagcttgatcaagaaatgggagacaaactgaaaatcgtcaaaatcgacgtggatgaaaaccaagaaactgccggtaaatacggcgtcatgagcatcccgacacttctcgtgctaaaagacggagaagtcgttgaaacatctgtcggcttcaaaccgaaagaagctcttgaagagcttgtaaacaaacatctgtaagccgaaagcttccgttacggcagggcgattcctttgaaaggggtcgcctttttttgatcttccaaaagctgagaatggagaaaaacaaatgttcgtgatacactgaatggacacgagaaatgaatgtaaggaagggtaacgtatggataaacaactgaaagaaaagctggccctccttcccgatcagccgggctgttatttaatgaaagaccgtcagaaaacagtcatctacgtggggaaagcgaaagtcttgaaaaacagggtgcggtcttatttcaccggttctcacgacgcgaaaacccaacggctggtgacggagattgaggactttgaatatatcgtgacttcctccaatcttgaagcgcttattttggaaatgaatctgattaaaaaatacgatccgaaatacaatgtcatgctgaaagatgataaaacctatccctttattaaaatcacccatgaacgtcatcctcggctgattgtcacccggaatgtcaaaaaagacaagggacgctatttcggcccgtatccgaatgtgcaggcggcgcgggaaacgaaaaaactgctggaccgcctttacccgctcaggaaatgctcaaagcttccggaccgcgtctgtctttattatcatctcggccaatgcctcgccccatgtgtaaaggatatatctgaggagacaaaccgcgagattgttgaagacatcacccgttttttaaagggagggcataacgaaatcaaaaaagagcttgaagcgaaaatggcagaagcggccgaaaagcttgaatttgaacgggctaaagaattccgcgaccagcttgctcacatcgaatcgacgatggagaagcagaaaatgaccatgaatgaccttctggaccgcgatgtgtttgcatatgcctacgataaaggctggatgtgcgttcaagtcttttttatacgccaaggaaaactgatcgaacgcgatgtcagcatgtttccgatgtatcaggaagcggatgaagagtttctgaccttcatcggccagttctattccaaaaacaatcactttctgcctaaggaaattctggtgcctgacagcgttgacagggacatgattggcgagctgttggaaaccgccgtgcatcagccgaaaaaaggtccgaaaaaagagctgcttttgcttgcgcacaaaaatgcgaaaatcgccctgcgggaaaaattctcgttaatcgagcgggatgaggaacggtcaatcggtgcagccgaacggctcggcgaagcactgaatatttacacgccgcatcggattgaagcgtttgacaactccaatattcaaggcacaaaccccgtatcggccatgattgtctttattgacggaaaaccgaataaaaaggaatatcgcaaatataaaattaaaaccgtaacagggccggacgattacggctcaatgagggaagtcgtcagaagaagatacacgagggtgctccgcgaaaatcttccgctgccggatttaatcatcattgacggcggaaaagggcagattaacgcggcgcgcgacgtgctcgagaatgagctcggccttgatgtcccggtagcgggactggcgaaagatgataaacaccggacatcgaaccttttgatcggcgacccgcttgaaccggtgtttctggagcggaacagccaagagttttacctgcttcagcgcattcaggacgaagttcaccgttttgcgatcagctttcacagacagatccggggaaaaagcgtctttcaatccgttctggatgatatccccggaatcggcgaaaaacgcaaaaaaatgctcttaaaacatttcggatctgtcaaaaagatgaaggaagcaagccttgacgatatcaaaaaagccggtgtgccggccgcggcggcccagttgctgtttgaaaaattaaaaaaatagtattgtgcttttctgaaaaatctgctagaatgtgaactaatttcataagatcgtgttatatggtgaagatagaggtgcgaacttcaatagtaagcctttggagaatgatggattctgcgaaaaaggctgaaaggggagcgtcgccgaagtgtgtcacatcccatcggtgtgatttgctggccttgcattaaataaatgtaaggctgtcaagaattcattttcttggagggctatctcgttgttcataatcaatcgtactgatatgaaaagcaatgagagctattcctctcattgctttttttattgtggacaaaacgctcttttctcctcacccgcacgaaccaaaatgtaaagggtggtctagtatgggtcttatcgtacaaaaattcggaggcacttccgtcggctctgccgaaaaaattcaaaatgccgcaaatcgcgccattgctgaaaagcaaaaaggccatgatgtcgtagtcgtcgtttcggcaatgggaaaatcaaccgacgcgctcgttaacctcgcggctgaaatcacatctgaaccaagcagacgcgagatggatatgcttttgtctacgggggagcaggtcacgatttcgcttttggccatggcgcttcaggaaaaaggatatgacgccgtctcttatacgggctggcaggcgggtgtccgcacggaagccgttcacggcaatgcgagaattacggatattgatatcacggcgattcgttcgcagcttgcagaaggcaaaattacagtcgttgccggttttcagggcgtaacggaagacggcggcatcacgacgctcggacggggcggttctgataccacggcggtcgctcttgcagcagcgctggaagcggataaatgcgacatttatacagatgttccgggcgtatttacgacagatccgcggtatgtccggtcagcgagaaaactggcggggatttcttatgatgaaatgctggaacttgcaaatctcggagcgggtgttcttcacccgcgggcggttgagttcgcgaaaaactaccaagtgcctttagaagtgcggtcaagcacggaacatgaagccggaacattaattgaggaggaatcatcaatggagcagaatttaatcgtcagaggaattgcatttgaagaccagatcacaagggtgtccgtcacgggccttgcaagcggactgacaacactttcaacaatcttcaccgcgctggcaaaacgaaacatcaacgttgacatcattattcagacacagtcggatgatggggaagcggatatttctttctcagtgaaaacggaagatgccgcccaaacggtcgccgtgcttgaagaatataaaaacgcgcttaactatgaaaaaattgaaaccgaaagaaaactggcgaaagtctccattgtcgggtcgggcatggtttcaaatcccggcgtcgccgcggacatgtttgccgtactggcggaaaaaaatgtacaagtcaaaatggtaagcacatccgaaataaaagtatcagcggttgtcagcgaaaatgatatggtgaaagcggtcgaagcgcttcatgatgcgtttgagctgtctaaacagccgtctgccgtataaacgggcaggcaaaaaggcgggacttttgagtcaccgcctttttcaattatacagggtccttcatatcccattttacagtcaggacgactttatccgctctcttttttacctgttcataagattctgcaatctgatcgttcatcaattgaatctgttcggctataaaaccggcttcaagctggaaacaaggctctttctgatgtttgagcctgctggatacgagcggtccttccagttcaaattccagttcttgttttttcgatcctgcgtttgtcaaagttccccagccggctttttcaaaaaaggcggggatttcttcccacgattgaagaggaaatttgcgggcgaggcgttttcccgcccaatacatcatcgatgaatgatccggaccgaggatatccggaagcacgatttcccggattaattcgtagccgtatgcgctgacgtcgagttcagttaaaggttctaaagctgcttcataattattcttcatattatgtattcccctctctccttcgtttattatagcttaaacaggggggaggattacaggatgatcctataaaacacgcgaaaaaatgtgagaaagatatcgcaggaaaataaaattttccctccagataatcaattccgaaaattataatttatgtacacgttttcttgacgcccttttgagggaggagtaaaatgaaattgtcaataaattttaataaagtgcttacaattgaaacgaagtgggggcagagattttagtacatttcgcacttaaatcaaacagggggtaaagtaatgtctgggaacagagagttttattttcgaagattgcattccttgctcggtgttattccggtcggcatctttttgatccagcatttagtcgtcaaccaatttgccgcaaggggagcggatgcgtttaacaaggcggccggctttatggacagtctgccgttcaggtatgcgttagaaatttttattattttcttacctttaatttatcatgcggtttacggtgtgtacatagcatttactgcgaaaaacaacgctggccactacagttatttcagaaactggatgtttgtgcttcagcgtgtcactggtattctcacccttattttcgtcagctggcatgtgtggcagacgcggattgccgcgcagatgggcgctgaagtcaacttcgatatgatggcgaatattctgagctcgccgtttatgctcggtttttacattgtaggcgttttatcggtcattttccacttttcaaacggcttatggtcttttgcggtcacatgggggatcacggttacgccgcgttctcaaagaatttcgacttacgtgacgctgattatatttttagcgctttcatacgtaggtttaaaagcgatttttgcgtttgtgtaagagaactagattactagagggagaggggctatcatgagtcaatcaagcattatcgtagtcggcgggggtctagccggcctcatggcgacaattaaagcagcggaatcaggcacggccgttaaattgttttccatcgttccggtcaaacgctctcactcggtctgcgcgcagggcgggataaacggagctgtcaacacaaaaggggaaggagactctccgtttgagcattttgatgacacggtatacggaggcgactttttggcaaaccagcctcctgtaaaagcgatgtgtgaagcggcgccgtccattatccacttattggaccgcatgggggttatgtttaacagaacgccggaagggctcttggacttccgccgtttcgggggtacacagcatcacagaaccgcttacgcgggagcgacgacgggtcagcagcttctttacgcactggacgagcaggtgcgcagatatgaagtggcgggtctcgtcacaaaatacgaaggctgggaattcctcggcgccgttcttgacgatgagcgcacgtgccgcggtatcgtagcccaaaatctgaccaatatgcaaatcgagtcattccgttctgacgccgttattatggcgacgggaggacccggaatcgtattcggaaaatcaacaaacagcatgatcaatacgggatctgccgcatcaatcgtctatcagcagggcgcttattatgcaaacggcgaatttatccaaattcacccgacagcaatcccgggggacgataaactgcgtctgatgagtgaatcggcgcgcggcgagggcggtagagtctggacgtacaaagacggaaaaccttggtacttcctcgaggaaaaatatccggcttacggaaacctcgtgccgcgggatattgcgacacgtgaaatctttgacgtgtgcgtgaatcagaaactcggcatcaacggagaaaacatggtgtatctcgatctgtcgcacaaagatccgaaagagcttgacgttaagcttggcggcattatcgaaatctatgaaaaattcatgggcgatgacccgcgcaagcttccgatgaaaattttccctgccgttcactattcgatgggcggactgtgggttgattatgatcagatgacaagcatccgcggactgttcgcagcgggtgaatgtgattattcaatgcacggaggaaaccgtttaggggcgaactctctgctttccgccatctacggaggaatggtggccggaccgaatgcggtgaaatatgtttccggacttgaaacatcagcggaagacctgtcttcttcattatttgattcctatgtgaaaaaagaagaagaaaaatgggccgatatcatgaagatggacggcgatgaaaatgcctacgtgcttcaccgtgagctcggagaatggatgacggccaacgtcacggtggtccgccacaacgacaagcttttgaaaacggatgacaaaatccaagagctgatggaacgctttaagaaaatcaatatcaacgatacgacaaaatggagcaaccaaggggcgatgttcacccgccagttctccaatatgcttcagcttgccagagtcatcacgctcggcgcatataaccgaaatgaaagccggggagcgcactataaaccggatttccctgaaagaaatgacgatgagtggctcaaaacgacgatggctaaacatgccggtccgtttgaagctccggaatttgaatatcaggatgtcgatgtatcactgattgcgccccgtaaacgcgactactcgaagaagaaggtggcgaaataatcatgagtgagaaaaagatacggtttatcattacacgccaggatacgcccgaaagcgcgccatacgatgaagaattcgaaatcaattaccgcccgaatctgaacgtgatttccgccctgatggaaatccgcagaaatcccgtgaatgcaaaaggagagaaaaccactccggtcgcatgggacatgaactgtcttgaagaagtatgcggcgcctgctccatggtcatcaacggaagaccgcgccagtcgtgtacggcgctgattgataagctggaacagccgatccgtctgaagccgatgaaaacattcccggttgtccgtgaccttcaggttgaccgcagcagaatgtttgattcactgaaaaaagtgaaagcatgggtgccgattgacggaacttacgatttggggccggggccgagaatgccggaaaaacgccgccagtgggcatatgaattgtctaaatgcatgacatgcggcgtctgccttgaagcctgcccgaacgtcaacagcaagtcgaaattcatggggcctgccccgatgtcacaagtgcgtctgtttaatgcccatccgacgggcgcgatgaacaaagcagaacgtttagaagctttaatgacagacggcggcctcggagattgcgggaattcacaaaactgtgttcaatcctgcccgaaaggcattccgcttacgacttcaatcgctgctttgaacagagataccaatttacaagcattccgtaatttcttcggaagcgacagagtataagaaagagaaaaagagcctcttccgcacgggagaggtttttttataaggagctgaaggtgatgaaacaaccgcaatatattgatatcccgtttgaagaatggagacagtcgttttctttctttactgaagtatcggttcgtttttcagaaacggatatgttcggccatatgaataatgtaacccctttcatctattttgaagaagcacggatcgcttattttaaacagcggggcatgacggcgcaaaactcggaaacgatgacggtcgtcgcaagccagcagtgcgactatatgcgtcaggtgatgccgtatgaaaatctgcggatttatgtgaaagcaagcgctgccggaaatgcgtccgtcacccttcattaccttggagaaaatgagtcgggcctgccgtgctttacaggttccgtcgttatggttcaagtgtcgaaaaaaagcggcaaagcggtcagctggacggagcgggagaaaggcattctgctcgcctgaacggataactatttctctaagagacgtcacctccgaagcgccctttacatatgatatcttgactatataaacccattcgtttcagattcgctctcaccttagcaaggagggttacaatacttgaaggagaaagattttcaatcaaagccgctgctgaccaaaagagaaagagaagtattcgaattgctcgttcaagacaagacaacaaaggaaattgcaagcgagctatttatcagtgaaaaaactgtacggaatcacatttcaaatgccatgcagaagttaggtgtgaaagggcgttcgcaagctgttgtcgagcttcttagaatgggtgagctagagctctgattcttgccggttttccttctttacgagaaggagccggttatttgcgttggcgcccgggctgatgggcatgcggtgaaaatcccggtttttcctttttctccgtcagtcttgcattttcttaaaaaaagaaggaaaatagacacggagcgcatagcccagaaagatccttgagtgagggatggacaaatgacatcaaaatctgtagagcatgttgcggatatcgaaaaatcactccgccatatcgctgcgatcattaaacaaaaaggaagagaaatccttaaccaatatgcaattacaccgccgcaattcgtggggcttcaatggctttatgaattgggggatatgacaataggcgaattatcaggcaaaatgtatttggcttgcagcacgacgacggatctgatagaccgcatggaaaaaaataagcttgtcgagcgggtcaaagacccggctgacagacgggtcgtcagaattcatcttctcgctgaaggagagcgcattatccaagaagtgattttgaaaagacaggcttatttgcgggatatgtttgcgacattttccgaagaagaaacagccgctttcgaaaaatcattattgaaactgcagcatgaaatgaaaagaaaatgaggcgattttgttggaacagccgataggagtcattgattccggggttggcgggttaaccgttgctaaggaaatcatgagacagctaccgaaggaaaatatcatctatgtgggagatacaaaacgctgcccgtacggcccgcgtcctgaagaagaagttcttcaatacacgtgggaaatgaccgattacctgctggaaaaccaccatatcaaaatgctcgtgatcgcctgtaatacggccacggccattgccttggaggatattcagcgcaaaacggatattccggttgtcggcgtcattcagccgggtgcgagaacggcgataaaggtcacgaaaaaccagcatatcggcgtcatcggcacggtcaataccattaaaagcagagcgtatgagcaggcgctgctcgggttaaacgcagaacttcaagttgagaacacggcttgtccgctgctcgtgccgtttgtggaaagcggacggtttcttcaggaatcagcggaggaagcggttgaagcatcgcttgaacctttaaaaggtacatcaattgacaccttgattttaggatgtacgcattatccgatcttaaaagacccgattcagaattatatgggagagcatgtgaaaatcatttcctccggagacgagacggcgagagaagtgagcaccatcttgtcttataaaggtttgttaaaccaatcgaaacatgcaccggagcatcaatttcttacaacgggagagcggaacggcttcgcaaaaattgccgaagactggttcggccacgaaatcggccatgtcgagtgcatctcccttcaagagccggtcagaaaataaatcaaaaaaaccccgctgtttacagcgggtttttttgcgcttcccggtctatttcccggacagggctcgtatacatcatagtacaaacagccttaggagggaaaagtatgctgaaaaaaggacctgcagtcattgctgcaacatgtcttacttcggcttttgtgttatctggatgcggtttgtttcaatccgataaaacagccggggaaattgacccgcctcaagacatttcatatgtaaaggatgaagcgggaattcaggcaaaaccaaagcagtcagagaaaaacggcacttctaaagccgaccagccggccaatacagtcatgcgagaactgtatctgattgataaaaacggctatgtcgcagcacagacactgcctcttccgaacagtgagggaaccgcaaagcaggcccttgagtacttggttcagggagggcctgtatcagaaatcctgccgaacggcttcagagcggtgctccctgcggatacgacggtaaatgtcgatattaaaaaagacggcactgcagtcgctgatttttcgaaggaatttaaaaactataaaaaagaagacgaacaaaaaatcctgcaatcgattacgtggacgcttacccaattcagctcaatagataaagtcaaaatcagaatcaacgggcacgaactgaaagaaatgcctgtgggcggcacgccgattacgggcgacttaagcagaaaagacgggattaatattgaaacggccggagtgaatgatctgacagacacccatccgctgactgtatattatctggcggaaacagagacaagcgaatactacgtgcctgttacaaagcggattgacaattcggaaacaaatgacatcaccgctgccgttgaacagctcaccgacggaccgggcaaagcaagcgggcttttgacggactttaataacgatgttaagcttctcagcaagccgaaagtgaaagacggccaggttacactggactttaacagctctatttacggaagcgccgacgaaaaaacaaaaatggtgtcatcgggcgtactggacagcatcgttctcacgttaaccgaacagccgtcgattaaaagtgtttctataaaagtaaacggaaaatcagaactggtgaatgaaaaaggagaatccctttcaaaacctgtttcgaggccggcacaagtgaatacgggtagtttttaatttgcgatttttgatatactagtaaaaaagaggttagcgttccggctgcctctttctttattcacaatccggaacaaaaggtttatgtacatataatcggaggtaaaatatgagacacgacggaagacagcacgatgagctgcgccctatcacatttgatttggattttatcactcacccggaaggctctgttttaattacagcgggaaatacaaaggtcatctgtaatgcatctgtggaagaccgggtgccgccatttttacgcggcggaggaaaaggctggatcacagcggaatacagcatgcttccccgcgcgacgaatcaaagaacgataagagaatcttcaaaaggaaaggtctccggcagaacgatggaaattcagcggctgatcgggcgcgcgctccgggccgtcgttgatttggagaagctcggcgaacggacgatctggatcgactgtgacgtcattcaagctgacggcggaacaagaacggcttccattaccggcgcattcttggcaatggccattgcgaccggcaaactcgtaaaaagcggcgttatcaaaacctctcccgtgacagattatctcgcggccatttctgttgggatggataaagaagaaggccttcttttggatctgaattatgaagaggattcggcggctgaagtcgacatgaatatcatcatgacgggaagcggacgttttgtagagcttcaagggacgggcgaagaagccacattctcccgtgaagatttaaacggactgttaagccttgccgaaaaaggaatccagacgcttattcaaaagcaaaaagaagtgctgggagaaacattgcctgaactgaaataagaaagagaggcctgatcagcgtgaaagaagtcattattgcgacacacaatcagggaaaagtgaaagaattcaaggaaatactcgaaccgaaaggctacagcgtctcttctttggcggaaatcggatttacggaagaaattgaggaaaccggacatacctttgaagaaaacgccatcttaaaagcggaagccgtggcaaaagccgtcaacaaaatggtcattgcagacgactccggtttatcagtggacaaccttggaggcagaccgggcgtttattcagcccgttatgccggagaagcaaaagatgataaggcgaatatggacaaggtgctgtcagaattaaaaggcatcgaaaaagagcagcgcacggcccgtttccgctgcgcccttgccgtcagcatgccggggcaggaaacaaaaacggtcgaaggtcatgttgaagggtatattgcagaaggacccgaaggagataacgggttcggctatgatcccatttttattgtaaaagataaagataaaaccatggcccagctgacaagcgctgagaaaaacaaaatcagccacagggctgaggcgctcaagaaactgtcaaagctgcttgattcataagggggagcgtatgcaatgaaagtgctgataataagtgacagtcacggccttgaagacgagctggagacgattgcaaagcggcacgaagacgaagcggatctgatgattcattgcggtgattcagagcttgacgccgcacatccggcactcacgccgtatcacaaggtgaaaggcaattgcgactttggcggcgggtttcaggatgaactccttctggatgccggttcaaagaaaattctggccgttcacgggcatcttcacggcattaaacagtcacttttaactgttttttaccgggcggaagagcttggggcggatatcgtctgcttcggccattcacatattgcggggagtgaagtgcttcggggcaagcttttgattaatccgggcagcatccgtcttccgagagtccgcaatgtgaaaagctatgccattcttactcttacagaaagagaaggcgccgtgacattttacgacgaaacgggtcgggaattgaaggacttggggaatacaatcagtttttaacaagtgatgggggagatttcattcttccccatcaaaagttttttaaaaaatattgacttatgatttgaacctgtatataataaatcttgtcgctgatacataaagcaaaagctgtcccagtagctcagctggatagagcaacggccttctaagccgtcggtcgggagttcgaatctctcctgggacgtacaaaaaaagagctggtgacatcagagtgaaaactgatgccgctggccttttttatcggatgactatattgtcaattcactgatatcatggtaaaataatcagcagatatttgtttttcatgtcccagtagctcagccggatagagcaacggccttctaagccgtcggtcgggagttcgaatctctcctgggacgtataaaaaacctcaagccctgacaatgggtttgaggtttttttgtattttatttttagttttacgaaacaaaagttccgtatttgatgaaaattgtaaagtaattttaatgtaaatgaaacttaatgtaatatttaccgtaataaatatatgtataaagatacttaaggcgcccttgagtgataaattatctgatttctatcatacgttttgttgatgattgatagaaagacagcaggaggaattagcttttgaagtacgcatttgcatataaaaatcacaatatagaaacgatcttttgcggaaaagacgagctgtttgaggaactgaaacaatttttaatcactcaatgcggtttaatcattgttgaggtttcaagggctgattactatacggagcaggaaatgaatcagtggaatgaacgttatactctgtgaataagaaaagaaaccggccgtgtgagaccggtttttgtatcatctgaatccgctcggagcgctgaagcccccggcatggccgctgaaaccgccaccgagcgcgccgggatgtgccccggcgccgaggcttccgccgacgtcactgaaggtttggccgtagtacccggatgtataagggtacggaacgaattgctgtccggcgaatgacagtgtgctttgcggggtctgctgtccgtatccggatggcggaaatccctgctgaaaagaagggccgccttgatatggtgctgtatgcatcggggccggaggatagtaagactgcggcggtaagaccggtaaaggcggaaatccaggaggcaggccctgcatgcctgataacatcttattcatgacatcactcatttcttacgagataagaacagtgtatgcgtatgtctgtataaagagcctgttcaatcgaacggaatatctgacaagcatgccggaaggacagagaaaaatcgcgtaataaaatgtgacatattcgtatatgaacggaaaaatttcatgtaatcttgagagattaataaaaaaaatataaaaacttttaacatttgccgatccttttatatcagtaatgaaagcgtatacaaaatagattgattaatctaaattgtctaataattataaaaatgctgttgacactgtctgcaaacgggcgtaatatgagttcaaacaaaaataaataaatgattcacactaaaaagaaaaatcataaaacactgaaaaaacaaacaaatgaaggttcttttttaataaaagagctgccataataaaaagcgcagaagaggataagtagctttgctgaagtttttcacagagagccggtaacgctgagagccggtaaaacaaatcaaagtgaactcccctcagagtgccggtctgaaatgtaaagagtaggactcggccgagtgaacgcaatgtttactcgttatcaaaacggataatcattatccatgagacggtctgcatatgaccgtaaacaagggtggtaccgcggagagcaaagccttttcgccccttttggctatcgcatgaaatgcttggctgaatgtgggtgggaaggcttttttatttgcgtcagccggcgctgcgttttatgaattggattttagaagggaacattgaaaaggaggaactgaaaatgggcacaaatgtacaggcggattctttgtctgccgattgtacaaaaacaatgaacggggctctgatgctgattgaatcattaaagaaagaaaatgtcgagatgatcttcggctatccggggggagccgtccttccgatttacgataaactgtatcaatcaggattggttcacatcctgccccgccacgagcaaggcgcgattcatgcggcagaagggtatgcgagagtctccggaaagccgggggttgtgattgctacctccggacccggagcgacaaatttagttaccggtcttgcggatgcgatgattgattcactgccgctcgtagtgtttaccggtcaggtcgccacttcggtcatcggcagcgacgctttccaggaagccgacattttaggaattacgatgccgattacgaaacacagctaccaagtccgccgtccggaagatctcccccgtgtgattaaagaggcgttccatattgccacgacgggaagaccgggcccggtattaattgatataccgaaggatgtcgcagcatttgaaggagaattcagatatgatcacgagatcaatcttccgggttatcagccggtaaaagagcctaactatctgcagatccgaaagctcgtggaagctgtcagcagtgcgaaaaagccggttattttagccggagcgggtgttttgcacggtaaagcttcagaagatttaaaaaattatgccgaacagcagcaaattccggtagcgcacacgcttctcggtctgggcggtttcccggcagaccatcctctttttctgggaatggcggggatgcacggcacatacacagcgaatatggcgctttaccactgtgacttgctgatcagcatcggagcgcggttcgatgatcgcgtgaccggaaatctgaagcattttgcaaaatcggccaaagtagcgcatatcgatattgatcctgctgaaatcggaaaaattatcgaaacgcagattccggtggtcggcgacagtaaaatcgtccttcaggaattattgaagcaaaacggaaaacagggacagacagaggaatggaaacagcagctttcagaatggaaagaagaatatccgctttggtatacagacgacagagaagagggcttgaaaccccaaaagctgattgagtatattcaccaattcacaaacggtgaggcgattgtggcgacggatgtcggccagcaccagatgtgggcggctcagttttatcctttccgaaaggctgataagtgggtgacctcgggggggctcggcacaatgggcttcggccttccggcggccatcggagcgcagctggccgatcgtaacgccacggtcgttgccatcctcggagacggcggttttcagatgacccttcaggaattagatgtcatccggcagctgaatcttcctgtcaaagtggttatcttgaacaacgaatgtctgggcatggtcagacagtggcaggaaatcttctatgaagaacgctattctgaatccaaattctcggcgcagcctgactttgtcaaattgtcagaagcctacggcattaaaggcgttcggatttcatcggaagaagaggcggaagaagagcttaaaaaggcgctttcatcaaaagaaccggccgttattgacgtccgggtcgccaaaagcgagaaagtattcccgatgatcgcgccgggtaaaggacttcatgaaatggtgggggtgaaaccttgaaacgcattatcacattaacggtggtcaaccgctcgggggtattaaaccggatcaccggcctgtttacaaaaagacactataatatcgaaagcatcactgtaggccacacggaaacaagcggtgtttcaaggattacatttgtcgtccatgtggaaggcgaaaatgacgtagagcagctgacaaagcagcttaacaaacaaattgacgtcctgaaagtgacggatattacaaaccaatcgattgtacagcgtgagctggcattaatcaaagttgtttccgcaccgtcggccagaacggaaatcaatggaatcattgagccgttcagagcttccgtcgttgatgtctcaagagacagcatcgtcgttcaggttaccggcgaatctaataaaatcgaagcgctcatagagcttctcaaaccttacggaattaaagaaatcgcgagaacgggcacaacggcttttgcgaggggaacccagcagaaggcgtcatccaataaaacaatttcaattgtataacacaaaaaagggagagattaaaatggtaaaagtatattataacggtgatatcaaagagaacgtattggcaggtaaaaaagtagcgattatcggttacggttcacaaggtcatgcacacgcgctgaacttaaaagaaagcggaattgatgtcattgtcggcgtcagacaaggcaaatcatttacacaggcccaagaagacggtcataaagtcttttcggtaagagaagcggctgcccaggctgatatcattatggttcttcttccggatgagcagcagcaaaaagtatatgaagctgaaatcaaagatgaattgacggcgggcaagtcattggtattcgcacacggatttaacgtccatttccatcagatcgtgcctcctgctgatgtggatgtattccttgtcgcccctaaaggacctggacaccttgtcagaagaacatatgaacaaggcgcgggcgtaccggcattgtttgccatctaccaggatgtatcaggcgaagcgaaagatacggctcttgcttatgcaaaaggaatcggcggagcgcgtgcgggggttcttgaaacaacatttaaggaagaaacggaaacggatttgttcggtgagcaggctgttctgtgcggaggtttaacggcgcttgtcaaagcgggttttgaaacgctgacagaagccggctaccagcctgaactcgcatacttcgagtgtctgcacgaactgaagctgatcgtagacttgatgtatgaagaaggattggcgggcatgagatactctatttccgatacggctcaatggggagactttgtatcaggaccgcgcgtagtcgatgcgaaggtaaaagaatcgatgaaacaagtattaacggatattcaaaacggtacattcgcaaaagaatggatcgtggaaaaccaagtgaaccgtcctcgtttcaatgcgatcaatgcaagcgaaaacgagcatcagattgaaaaggtcggcagacagcttcgtgaaatgatgccgtttgtcaaacaaggcaaaaagaaggaagcggtggtctccgttgcgcaaaattaatgttttcgacacgacccttcgtgacggtgaacaatctcccggggtcaacctcaattcccgggagaaactggcgatagccaagcagcttgaaagactcggggtggacattattgaagcgggatttcccgcttcatcccgaggtgattttttagccgtgcaggaaatcgcaagaacgattaaaaattgttcggtaacagggcttgctcgatctgtcaaaggtgacattgacgcagcctgggaagcgctgaaagacggggtcagcccgcgcattcacatctttatcgccacctctgacattcatctgaagcataagctgaaaatgacgcgggaagaggttaaggaaaaagcggttgaaatggtgaagtatgcaaaagaacgctttccgatcgttcaatggtcggcagaagacgcatgccgcaccgaacttccgtttctggctgaaatcgtagaaaaagtgattgatgccggcgcgagcgtcatcaacctgccggacactgtaggttacctgacgcctgctgaatacggaaacatctttaaatatatgaaggaacacgttccgaatatcagccgggtaaagctctctgcccattgccacgatgatctcggaatggcggttgccaactcactttcggcaattgagaacggcgctgatcaaattgaatgcgccattaacggcataggagaaagagccgggaacgccgcgctagaggaaatcgccgttgcgcttcatgtcagaaatgacgcgcatcaagccgattcatctctcaatcttcatgaattgaagcggacgagtgatcttgtcagcaaactgacgggcatggccgttccccgcaacaaagcaatcgtcggagataacgctttcgcacatgaatccggcattcaccaagacggtttcctgaaagaaaaatcaacatatgaaatcatttcaccggaacttgtcggcgtgactgctgatgcgctcgtactcggaaagcattccggacgccatgcgttcaaagaccgcctgaatgcgcttggattccagtttgatagtgaggaaatcaataaattttttacgatgtttaaagaactgaccgaaaagaaaaaagaaatcaccgatgatgacttgatttctcttattttagaagaaaaagtgacggacaaaaaaatcggctatgaatttctgtctctgcaagtgcattacggaacgtctcaggtgccgactgcaacagtctctttgaaaaatcaggaaaacgaacagctgattcaagaggcggcaacgggggcgggcagcgtagaagccgtttataatacgctcgggcgctgcatcgataaaaatattgaactgacagactaccgcatccaatccaaccggaaaggcgaagacgcgctggctcaagtttatgtcagagtgaccgtgaacggaaaagaaacatcagggcggggaatcgcgcaggatgttctggaagcttctgctaaagcttatctgaacgccgtgaatcggcagttggtgctggattgcaatttagacggattaaagagacggactgcggtcggctcgtaatagaaaggagaacgtttgatttgaaaaaacgcattgctttgcttccaggtgacggaatcggaccggaagtggcggaatcagcggcagatgtattgaaaagcgttgctgaacaattcggacatgaatttgaatttgaaaacgggctgatcgggggagcagcgattgacgcccatcaaaacccccttcctgaggagacggtggctctttgtgaaagatccgacgccatcctgctcggggcagtcggcgggccgaaatgggaccaaaaccctccggagctcagaccggaaaaaggcctgctcggcatcagaaaaaagctcggcctgtttgccaatctgcgtcctgtgaccgtatttgaaagcctgtctgaggcgtctccgctgaaaaaagaatatatcagcggcgtcgactttgtaatcgtcagggaactgacgggcggcctctacttcggagaaccgagcagacagtatgtcaatgaagcgggagaaaaggaagcggtcgatacccttttttataagaaagaagaaatcgcacgcgttgtcagagaagcctttaagatggctgccggcagaaaaggaaaagtgacgtccgttgataaggcgaatgtgctttcttcaagcagactgtggcgtgaaacggcagatgaaatcgcaaaagaatttcctgatgtgacgcttgaacatatgcttgtcgataatgccgcgatgcagctcatctacgctccgagccagtttgacgtcatcgtaactgaaaatatgttcggcgatattttaagcgatgaagcctccatgctgacaggctcgctcggcatgctgccgtcagccagtttatcaagttcaggtcttcacttgtttgaacccgtgcatggatctgcgcctgacatcgccggtaaagggatggccaatccgtttgcggcgattttatcagcggcgatgcttttgagaacatctttcggacttgaaaacgaagcgcaggcggtggaaaaggcggtcgcaaaggtgcttgcagacggcagccgtacacgtgatatcgcccgggacggccaatatgccggaacgcatgacattactgaaaaagtaaaagccgcattagccggctcgaatacaaaatctatagtatgacgctttaaagaaagcggtcttagttcaataggtagagggaggaaacaaagatgatgcctcgaacaatcatcgaaaagatttgggatcggcatgttgtaaaaagcggtgaaggaaaacccgaccttctctatattgatctgcacctcattcatgaggtgacgtctcctcaggcgtttgaagggttaaggcagaagggaagaaaggtcagacggccgcagaacacgttcgcgacgatggaccacaatattccgaccgtcaaccgttttgacattaaagatgaagtcgcaaagcgccaagtaaccgcgcttgaacggaattgcgaggagttcggcgtccgtcttgcggatcttcacagcgcagaccagggaatcgttcatgtggtcgggcctgagcttggtctgacacttccgggaaaaacgatcgtttgcggagacagccatacatcgactcacggcgcgttcggagcgcttgccttcggtatcggcacaagtgaggtggaacatgttctttccacacagacattatggcagcagcggccgaaaacgcttgaaatccgcgttgacggaacgctccaaaaaggagtgacagcgaaggatgtcatcttgtcggtcatcggaaaatacggggtgaaattcggtaccggatatgtcattgaatacaccggggaagtattcagaaacatgtctatggacgaacgcatgactgtctgcaatatgtcaatagaagcgggagcccgtgcgggactgatcgctcctgatgacacgacgattgaatactgtaaaaaccgtaaatacgcgccaaaaagcgaggaatttgaaaaagccgccgcagaatggaaagcgttaaaaaccgatccgggcgccgtatacgatcattccatcgtgttagacggcagcgagatttctccaatggtaacatggggtgtcaatcccggcatggttcttccggtcgatgcccaaatacctgcgccggaaacgattgattctgaagacggtaaaaaagaagccatccgcgcttacgaatacatggggatcgcgccgaatcaaaaaattgaagatattaaagtcgagcatgtgtttatcggctcctgtacaaattcacggatgaccgatcttcgccaggctgcggatatgatcaaaggccgaaaagtcgccgacagcgtcagagccattgtggtgccgggttctcaaagcgtgaaacagcaggccgaggaagaagggctgcaccgcgtgtttctcgaggccggctttgaatggagggaatcaggctgcagcatgtgcctcagtatgaacaatgatgtcgtgcctgaaggggaacgatgcgcttccacttccaaccgcaacttcgaaggcagacagggaaaaggcgcgagaacacaccttgtcagtccggcgatggcggcaatggcggccattcacgggcatttcgtcgatgtaagaaagttttatcaagaaaaaacagttgtgtaaggagtgcgcgaaaagatggaacctttaaaaacgcatacgggaaaagcggccgtcttaaaccggatcaacgtcgatacggaccagattattccgaaacagtttttgaaaagaattgaaagaaccggatacggcagattcgcgttttttgattggagataccttgagaacggtgagcctgatcctgaatttgaattaaaccgcaaagtctatgaaggcgcgtccatattaattgccggagagaatttcggctgcggatcatcccgtgagcacgctccttgggcgctggatgattacggcttcaaaatcatcattgctccgtcatttgccgatatttttcatcagaactgttttaaaaacggtatgcttcccatccgtatgccgtatgatcagtggaaaaaactcgccggtcaatatgaaaatcagtctctaaatatgacggttgatttggaaaaccagctcattcacgacagtgaaggaaaagagatttcatttgaagtcgatccgcactggaaggaaatgctgattaacggttatgatgaaatttcattaacgcttctgctggaggacgacattcagcagtttgaatcgaaaagaagttcatggcttcaagcctgaaaaaagccgcccggcatctgtccggcggctttttttaccgtgtgcatcatcctttcttgtgtttcatgacgcgtgttgatacacttgaacaaaataagcgcctgaaaggaaataaagtatgacgcatgacaagaaaaaagctgatatcattcctttcccccgtctgaaagaacgcttggttgataaagggatggccgccatgaaggataaacagtatgaggaggccctcgaactgttttcagaggcggtaagccacggcgataccgagtccgacgtacatttaggcatggcgatttgttttctggaactcggggaattggaagaagcaaaacaagtttgcgagaaaatgctgaatgaagggtacggccattatttcaccgtattgcaggtgtacatgaccattttaattcagctgaaacaatatgaagaagtcaaaagcacaattgaagctgtgctggaagaaaaccagctgcccgcagaaagtgcggagcaattctaccggctgctcgaattcagccgcaaaatgaccgatcccgatcagcaggaggaggcgtgggaggaggaatacgaggacattcttgatacggaaaaagtgctgaacagccccgctgaacaaatgaatctgattcattctcttaaagaccgcaatattgcaaaatacacgggtctcttaaaaacgattcttcaagatccgggcgcgcatcctcttattaagacaatgattttgacgctgatggccgagcacgactacagtaaaccggtccatattacaaaattcggcgattcaatgaccgcgataccgagtgaaacggtccagcctgatgcggctccgattttgcatcgcgttctccgggtgcttgatgaaacgctgggcaatgaaaaccctacattatatgctgccgtcgaggagctgtggagaagacatctgtacgtcctgcacccttttatgccgaagtttttgaacgcggatttatgggcggcggcgcttcataaggtcggttacgagatgcacggcattgacattgagccggaggaacttcatatgatgtacgagtttgacagccgcgaactcgaagaagcctgcacgatgattaaggatattgaagaaatttcttatttgtaaatcacaccatatagttgaaagcggtaggcgttatgttataatatagtggttgtatttatgtatagcggtttaactgaaatgagaattacggttggacaggctgccagttcattacataatgattctgattcaaagcggttttttctttgacaaagccgcggattgctttagaatggaagaccgacacaacctgaatagatttttggagggaaacacatgtctgtaaaatgggaaaaacaagaaggcaacgaaggcgtattaacggttgaagttgatgcggatacgttcaaaacagctcttgatgatgcatttaaaaaagtagtaaaacaggtttctattcctggattccgcaaagggaaagttccccgcggtttattcgaacagcgtttcggcgttgaagctctttaccaggatgctttagatattttacttcctgtagaataccctaaagcggttgaagaagccggcattgagcctgtagaccgccctgaaatcgatgttgaaaaaatcgaaaaaggcgaaagcttaattttcactgcaaaagtgactgtaaaaccggaagtgaaacttggcgattacaaaggcttaggaatcgaaaaagatgacactgccgttactgacgaagatgtacaaaacgaacttaaagcgcttcaagagcgtcaggctgagcttgtcgtgaaagaagaaggcgctgttgaaaacggcgatacagtcgttcttgacttcgaaggtttcgttgacggcgaagcgtttgaaggcggaaaagctgagaactactcacttgaagtaggatcaggttcattcatcccgggcttcgaagagcagttaacaggccttgaagcaggcgctgaaaaggatgttgaagtaacattccctgaagagtaccacgctgaagagcttgccggaaaaccagctgttttcaaagtgaaaattcatgaaatcaaagcgaaagagcttcctgagcttaacgacgaattcgcaaaagacattgacgaagaagttgaaacgcttgctgaattaaccgagaaaacaaaaaaacgccttgaagaagcaaaagaaaacgaagctgacgctaaattgcgtgaagagcttgttctgaaagcatctgaaaacgctgaagctgatgttcctcaagcgatgatcgacactgagcttgaccgcatgctgaaagaattcgaacagcgtctgcaaatgcaaggcatgaaccttgagctttacactcaattctcaggccaagacgaaaacgcgttaaaagagcaaatgaaagaagatgccgcaaaacgcgtaaaatcaaacctgactcttgaagcgatcgctcaagcagaaaaccttgaagtaacggacgaagaagttgaagcagagctgactaaaatggctgaagcttacaacatgccggttgaaaacatcaagcaggcaatcggttcaactgacgcgatgaaagaagatttaaaagttcgaaaagcaattgattttcttgtagaaaaccgttaatatggttcataataatagacataataaaacagggcgcgattaattcgtgccttgttttgtacaattatgatataactctttttcttggggcaagatagtcattgccgggctgtttttcgtcatacatatagaatgtgcaagtgcgaaacacattgttaccgtcttactggaaagtatggtaaaatgcaatacatactcgatcgtagcaagaaccgttttcttttgcccttcaggtaaaagaaaaagtgagacaagattaaggggtgaaagaatgtttaaattcaacgaggaaaaaggacaattgaaatgctcgttctgcggaaaaacgcaagatcaggttcgtaagctggttgcaggaccgggtgtatatatatgcgacgaatgtattgagctctgtacagaaatcgtagaggaagagcttggtacggaagaagaagtcgaatttaaagacgttccgaagccgcaggaaatccgtgagattctgaatgaatatgtcatcggacaggatcaggcgaagaaatcacttgcggttgcggtatacaaccattacaaacgcatcaattccaacagtaaagtggatgatgttgagctttctaaaagtaatatttctttaatcggaccgactggaagcgggaaaacacttcttgcccagacgcttgcgcgtattctgaacgttccgtttgcgatcgcggacgctacatctctgactgaagccggatatgtcggtgaggacgtagaaaacatcctcctcaagctgattcaggcagcagactatgatgtggaaaaagcagaaaaaggcattatctatatcgatgaaatcgataaagtagcgcgaaaatctgaaaacccgtccattacacgcgatgtatcaggcgaaggcgttcagcaggcgctgctgaaaattcttgaaggaacggttgcaagcgtgccgcctcaaggaggacgcaaacatcctcatcaggaattcatccagatcgatacgacgaacattctgttcatttgcggcggtgcatttgatggcatcgaacaaatcatcaaacgccgtctcggacaaaaagtcatcggcttcggctctgataataaagcggcagacctggaaaaagaagaactgctttctaaagttcttccggaagacctgctccgtttcggtctgattcctgaattcatcggccgtcttcctgtcattgcaagccttgagcagcttgacgaaacggcactggttgaaattctgactaaaccgaaaaacgcactcgtcaaacaatacaagaaaatgttagaacttgatgatgtcgagcttgaatttgaaggcgaggcattatctgaaattgcgaaaaaagcgatcgagcgtaaaacaggcgcacgcggcctgcgttctatcattgaaggcatcatgcttgacgtcatgtttgatctgccgtcccgcgatgatattgaaaaatgtgtcattaccggagcgacagtcgcagacggtgaagcgccgcgtcttgtattaaaagacggtactgttgtcggccaagataaaacatcagcataacacgacaaaacctcctgacccgaattaatcaggaggtttttttcttgtcctgacccttctgaaaatgtttattccgggctttgctgggagatactagcggacagaggaatgaattggatacataaatcgttttttcaggagggaccagcatgagttggacagggatcgcattatttgtacagctgtttttcgggatagtcatcggactatatttttggaatctgctcaaaaaccagcgaacacaaaaagtgacgatagataaagaatcaaaaaaggaaatggaacagctgcgcaaaatgcgcgccatcagtttatcagaacctttatcagaaaaggtgcggccgaaaagctttcaggacattgtcggccaggaagacggaattaaagcgttaaaagcagcgctttgcggaccgaacccgcagcacgtcattatttacggtcctccgggagtcggtaaaacggctgcggcgcggttggtattggaagaagcgaaaaagcataaacagtcaccgtttcaaaagcaggctgtttttgttgaacttgatgcgacgaccgcgcgatttgatgaacgggggattgccgatccgcttatcggttcagtgcatgatccgatttatcagggagcgggtgcgatgggccaagcaggcattccgcagccgaaacagggggctgtgacccatgctcacggcggggtattgtttattgatgaaatcggcgagcttcacccgattcagatgaataaaatgctgaaggtgcttgaagaccgaaaagtatttttagacagtgcgtattacagtgaagaaaatacgcaaataccgaatcacatccatgatatttttcaaaatgggcttccggcggatttccgtttgatcggagcgacaacgagaatgccgactgaaattcctccggccatccgttcgcgctgtcttgaagtatttttccgcgagctggaaaaggatgaacttaaaatcgttgcgaaaaaagcagccgacaaaattcagaaagagatttctgacgaagctctcagcgtgctgaccgcatatacgagaaacggacgtgaagccgtcaatatgatccagatcgctgccggcatggcggtgactgaggacagaaaagaaatcacgactgaagatatagaatgggttgttcattccagtcagctcacacctaaaaatgagcagaaaatcgccgatgaaccgcaagtcggcatcgtgaacggacttgccgtctacgggccgaacagcggcgcattgctggaaatcgaagtgaatgtcacacctgcgcaggacaaaggaagcctgaatatcacgggaattgcagaggaagaaagcatcggcagccaatcgaagtcgatccgccgcaaaagcatggcgaagggatctgtggaaaatgtgctgacggttctccgcacaatgggcatcaaaccttcagactatgacattcacgtcaattttccgggcggaggcccgattgacggaccttcagcaggtatcgcgatggccgcggggattttttccgcgattcaccgcatcccgatcgaccatacggtggcgatgacgggagaaatcagcctgacggggcttgtcaaaccgatcggcggcgtcattccgaaaattaaagccgcaaaacaggccggagcaaaaacggtcattatcccttatgaaaatcagcagtccattctgaaacgaatagacggaatcaccattaaagcggtaaaaacgttccaggaagtgcttgacgtcatattggttgaccctccttcagaacaaaaaccgtttgatatccaaatgaataaagaatccgtataaaccccatttttataatggggtttttttatggaggacatcttttcctttttcagaacagaaagaaagggtatactacgaagagactgttttatatacagggcaggcggataagccgattaaagcccgatcccggaattgtacaacgatgaaaaagttgtattataatggttcatactaaagtcacggaggtgtcagtcacatggcagaagatacaaaacgcagcatcccgctcctccctttaagaggcttattggtatacccgacaatggttttacatttagatgtaggccgtgacaagtcggttcaggctcttgaacaggcaatgatgcatgatcatatgatttttttagccactcagcaggatatttcgatagacgaaccgggtgaagaggatattttcgccgtcggcacttatacaaaaattaaacagatgctgaagctgcccaacggtacgatcagagtgcttgtagaaggaattcagcgggcgcagatccttgaatacaccgaactcgaagattatacttcggtcgatatacagctgatgcatgaggatgattcaaaagacgtggaagacgaagcgcttatgcggacgctgctggaccattttgaccagtacataaaaatttctaaaaaaatttccgcagaaacgtatgcggctgtgactgatattgaagagcccggcagaatggcggatatcgtcgcttctcatctcccgctgaaattaaaggacaagcaggacattctagaaacggcggatattaaagaacgtctgaataaggtcattcgttccattcataatgaaaaagaagtgctggagattgagaaaaaaatcggtcagcgcgtcaaacgttcgatggaacgcactcaaaaggaatattatttgcgcgaacagatgaaagccattcagaaggagcttggcgacaaagaaggaaaaaccggcgaagttcagtcgctcacggaaaagatagaagaagcaggcatgcctgagcgtgtcaaagaaacggcgcttaaggaattaagccgttacgaaaaagtgccgtcaagctcagcggaaagctctgttatccgcaactatattgactggctcatcgcccttccgtggtcggatgaaacagaagataaacttgatattaaaaaagccggggaaatcttagataaagagcatcacggcttagagaaagtgaaagagcggattttggagtatttggccgtgaaacagctgacgaaaacgctgaaagggccgattctttgtctggccggacctccgggagtcggtaaaacatctcttgcaaaatcaatcagtaagagcatggggcgcacttttgtgagaatttcactgggcggagtgcgcgatgagtctgaaatccgcgggcaccggcgcacatacgtcggggcgatgccgggccgtattatacaggggatgaaaaaagccggcaaacaaaatccggtctttctcctcgacgagatcgacaaaatgtcgtctgatttcagaggcgatccgtcttcggcgatgcttgaggtgctggatccggaacaaaacagcacattcagcgaccactatattgaagagacgttcgatttatcgaaagtactgtttatcgcgactgcgaataaccttgcttccatccctggccctctcagagacagaatggagattatcagcctgtcaggctacactgaaaacgaaaagctggagatcgtgaaagatcacctgctgccgaaacaaatcaaagagcacgggctcacaaagagcaacctgcagattcgggatcaggcgattacggacatcatccgctactacacgagggaagccggcgtgagaacgcttgaacgccagattgccgccatttgccgaaaggctgcgaaagccattgtgtctgaggagagaaaacgcattaccgttacagagaaaaatctggccgactatctcggaaaacggatattcagatacggacaggcggaaaccgaagatcaaatcggggttgtcacggggctcgcgtatacgacggtcggcggagatacgctgtcaatcgaagtgtcattgtcaccgggaaaaggaaagctggttctgacagggaagcttggagatgtcatgcgggaatcagcgcaggccgctttcagttatgtccgttcgaaagcggaacagttcggaatcgacccgaaattccatgagaagtatgacattcatatccatgtccctgaaggagcggtgccgaaagacggcccttctgccggaattacgatggccacggcgctcgtttcagcattaacggaccgtgcggtaaaacgcgaagtcggtatgacgggagaaatcacgctgcgggggcgcgtgcttccgatcggcggactgaaagaaaaggcgctcggcgcgcacagagcgggcctgaccactattattgcgcctaaagataacgaaaaagatatagaggatattccagaaagcgtcagagaaggactgaagtttatattcgtttctcacctggatgacgttttggaacatgccttagtaggagagaagaaatgaaagtcacaaagtcagaaatcgtgatcagcgcggtcaaacccgaacagtaccctgatggggggcttccggaaatcgcgctggcgggcagatcaaatgtaggaaagtcatcttttatcaattcattaatcaatcggaaaaacttggccagaacgtcatcaaaaccggggaaaacacagactttaaacttttacatcatcaatgatgaattgcattttgtcgacgttcccgggtacggatttgcgaaagtttccaaaagcgagcgggaagcatgggggagaatgattgaaacctatatgacgacccgcgaagagctgaaagcctgcgtgcagattgtcgacctcagacacgcgccgtctgctgaagacgtgaacatgtatgaattcctgaagtattacggcattcccgtcatcgtcattgcgacaaaagcggataagattccaaaaggaaaatgggacaagcacttaaaggttgtcaaacagacgcttgatatggatcctgaagatgagctgattttattttcctctgaaacgaaaaaaggcaaagatgaagcatggggagccattaaaaaaatgatcagccggtaatgaaaaacccaaaacgcagtgcgttttgggttttatcgtatagttttgttccgcttgataaacaataataaaaggctgattccgatgaaaacatacggccagtatgttttgaagtgttccgtcggaatatggacggactccagccacgccgtaatttgtttaaagaagtataaaaagagggaaaaaccaatcatggcagccgcttcgtatacatattcttttctggcagccgcaaataaggagaatccgaagacgaagagaatcatttcaaaatctcccggccaccatgagagctcaggtttggcgaaaaagtgtaaacctatgccgaaaagaagcatgccgatcaggacgtgaggcccggccgcttcctttttgccctgatacaagagcacagcccccaagagcataaggagcaccggccattccccctgattcgcaaacaggtgaacctgtccgctctgaagccatgcaaataatgaagcggcaagcagaagtcccggtaataaaattgatgtttttttcatcctgtcacctacccgcagtaaaggatttttagtatgatgattacagtgggaacgagctttttatactatagcataacatttttgaaatctgttcacattttcccgaagaaactatgttataattattataaataataaattctatgttagaatgattataaataaattgcgatgtacgggggtgcatgaaagcgatgcatattcttgttgtgggagtagattataaatccgcccctattgaaatacgcgaaaaaataagttttcagccggatgagcttgcagaagcgatgctccgcttaaaagaagaaaaaagcgttctagaaaacattatcgtgtcaacctgcaaccgcaccgaaatatatgcggtggtcgaccagcttcataccggccgttattatataaagacatttttatccgaatggttctcgctgccgaaagaagagctgtctccgtttctgaaattttatgagagcgacgcggcgatcgagcatttattccgtgtggcgtgcggtttagattccatggtcatcggagagacgcaaatactcggccaggtacgctcgagctttaaaacggcgcaggcagaaaagacgatcggcaccattttcaatgagctgtttaaacaggcggtgaccgtcggcaaacgcacgcatgccgaaaccgatatcggctccaatgccgtttccgtcagttacgccgccgttgaactcgcgaaaaaaatcttcggctcattgtcaaataagcacattttgattctcggtgcgggaaaaatgggcgagctcgccgcagaaaacctgcacggtcagggtatcggcaaagtaacggtcatcaacagaacgtttttgaaggcaaaagcgcttgctgaccgtttctccggagaagcgcgcagcttaaaccagcttgaatatgcacttgctgaagctgatattttaatcagttcgacaggcgcgagtgatttcgtcgtgtctaaagaaatgatggagagagcgggcagacagcggaaaggccgtccgttatttatggtggatatcgctgtgccgagagacctcgatccggcgcttaacgatcttgaaggtgtttttctgtacgatattgatgaccttgaaggaatcgttgaagccaacttacaagaacgccgcgaaaccgctgaaaaagtcgagctgtttattgaagcggcaattgttgagtttaagcagtggcttaatacgctcggcgtcgtgccggtcatttcggcgctgcgtgaaaaggcgctgtccatccagtccgatacgatgcagagcattgagcgcaagctgcctcatctgacggtgagagagaaaaaacttctcagcaaacatacgaaaagcatcattaaccaaatgctgcgcgacccgattctgaaagcgaaagagcttgcggctgaagcggattcagatgaaaagctgaagctgtttatgcagattttcgatattgaggaagaggccggccgccagctggacaaaagcctggataaccgccagacggttcattcgtttcaaaaggcagaagcaaaaacgggcttacgtccgcttgtaagtgagtgagggctgtatgattgatacagcaatggcaagacttaatgaagcgacaattgttatttatgcagtaagcgtccttttttactttatagattttcttcaacacaaccggaaggctggaaaaatagccttctggttgctttctattgtctggactctgcaaactgtctatctttcttatttcatgtggcagacgggcagatttccggtcttgaatattacagaggccctttacttttatgcgtgggtgcttgtcacgctttcacttgtggtcacgcagattctgcgggttgattttatcgtgtttttcacgaatgtcatcggtttctcgatgattgcgatccatacgttttcaccgacggatcagcattcggccgccttttccggccagctggtctcagagcttttggtcattcatattacaatggcgattctgtcttacggcgctttttccctttcttttgtcttttcgcttctttatcagtttcaatattctttattaaagaagaaaaaatggggaaaatggctgttgagaattgaagatttgtcaaaacttgattatatggcttacgttttaaatgtcatcggggttccgatgctgctgttgagcctgatattaggcgtgatctgggcgtatgtgtcgctggaaacgctgtactggtttgactcaaaagtgctcggctcgtttattgtgctgcttttatacagctactatttatatatcagaatgattaaggaactgcaggggaaagtggcggcgttatggaattcagcatgttttctcgtgctgatgattaattacttcctgctcggaagcctgtcacaattccattggttcagttaacgcacgcgcccaaacagattcgggaggaaagaaaatgagaacgattaaggtaggttccagacggagcaaactggctatgacccagacaaaatgggtgattaacaaactgaaggaattgaatccttcctatgactttgaaatccgggagattgtcacaaaaggcgaccgcatcctcgatgttacactgtcaaaagtgggcggcaaaggtttgtttgtcaaagagattgaacaggcgctgctgcatcaggagattgatatggcggttcacagcatgaaagacatgcccgccgttttgcctgagggtcttgtcataggctgcataccgaaacgtgaggatccgcgtgatgcgctcatttcaaaagggcatcaaaagctggacggcataaaagaagggggcatcatcggcaccagcagtttaagaagaagcgcccagattcttgctgaacgccctgaccttacaattaagtggatcagaggcaatatcgatacgagacttcaaaagcttgaaacggaagattacgatgctattattttagcggctgcggggctttcgagaatgggctggaaagatgatgtcgtatcggaattcctcgaaccggaccgctgtctgcctgcggtcggccaaggcgctcttgccattgaatgcagagagtcggatgaagagcttttgaagctgtttgcgcaatttaccgatgagtatacgcagcgcacggtggcagccgaacgggctttcttacacgcgatggaaggcggctgccaagtgccgatagccgggtatgcgtccgtcaatgaccgggatgaggttgaattggtcggtcttgtcgcgtctccggacggaaagacgatttataaagaaacagcggcgggacatgatccggaagaaatcgggaaacgctgtgcggcgatgatgtctgaaaaaggagccaaagcactaatcgacagcgtgaaacaggagctcgaacaggatggcaaatgaccttcctttacaaggaaagaccgtgctcgtcacccggaacaaaagacaggcagcaccgtttcgaaaaaaagtggaggcgctcggcggaacggctgtttccgcctctctgatcgcttttcaggaagcgctcccggatgaatgtgcggacagtctgcgggaagacctttctgaaccgggctggcttgtgtttacaagcgtaaacggtgtccggttctttttttcctaccttgatcagcatggccttgcgcttccggaacggaaaaaaatcgcagccgtcggtgaaaagacagcgcgcgccctgaaagagcggggagcccggacggatgcgatgcctgacgagtatgtggcggaatgtctggctgatactttaaaacggcacgcatcagctgccgaacccgtttcattgataaagggcaatttatcacgcgatgtcataaaagcggagcttgagccgcttggctatcaaataagggaatgggtgttatacaataccattcaggatgaaaaaggcatggacgagctgagacgggctgcatcccgctctcattttgattttattacgtttaccagttcatcggcggtgcatacgtttatgcacgcggtcggagacggagaaaaagcgtgggaaaacagcggtgcgagctatatcagcatcggccctttgacagagaaagcgctcttggaatacgggatctcatcccatgtgcctgacacctatacgattgaaggcatgctggacgtcatgtgcagcatgtcgggaaaggatagataatgatgaatcaaacatttaacagacaccgccgtttgcgcgcgaacgctgcgatgagagatctagtaaaagaaacacgtcttcacccttcagattttatttacccgttatttgtcgttgaaggactcgaaggaaaaaaagaagttccttccatgccgggggtttatcatgtatcactcgatttgttaaaggatgaaatggctgagctgatatcgctcggcattaagtcggtcatcgttttcggtgtgccggaagaaaaagacgcctgcggaacccaggcttttcacgatcatggcattgtgcagaaagggattgctgaaattaaaaagcattatcctgaaatgatcgtcatcgctgatacatgtctctgtgaatacacggatcacggccattgcggggtcgtgaaagacggagtaatcctcaatgacgagtcgcttgagctgctggcgcagacagccgtcagccaggctaaagccggcgctgacatcatcgctccttcaaatatgatggacggttttgtcacagtgatcagggaagcgctcgacaaagaaggattcacgaatattccgatcatgtcttatgccgtgaaatattcaagtgaattctacggcccgttccgcgacgcggctgacagcacgccgcagttcggtgaccgaaaaacataccagatggatccggccaaccgcctggaagcgctacgtgaggctgaatcagacgcggcagaaggcgctgactttttaatcgtcaaaccgtctatgtcatacttagatattatgcgtgatgtgaaaaaccgccatcacctgccgctggtcgcatataatgtgagcggggagtattccatggtgaaagcggcagcccaaaacggctggattaaagaaaaagaaatggtgctggaaattttaacgggcatgaaacgtgcaggagccgatctgattatgacgtatcatgcaaaagacgcagcgaaatggcttgctgagtaacgatttcatttgacgggagctgaggcagatgagaagctatgaaaaatcaaaagccgcttttaaagaagcgcagaaactgatgccgggcggagtgaacagcccggtgcgcgcgtttaaatcagttgatatggacccgatctttatgcagcgcggcaaaggatcgaaaatttttgatattgacggcaatgaatatatcgactatgtgctgagctgggggccgctcattttgggccacacgaacgacagggtcgttgaaagcctgaaaaaagtagccgagaacgggacaagtttcggggcatctactgaagtggaaaacgaactggccaaattggtcattgaccgtgtaccgtctgttgaaatcgtgcggatggtcagctccggcacagaggcgacaatgagcgccctgcgtctggcaagaggatacaccggccgcaacaaaattttgaaatttgaaggctgttaccacggccatggtgattcgctgctgatcaaagcgggatccggagtggcgacactcggcctgccggacagcccgggcgtgccggaaggaatagcaatgaatacgattaccgttccatacaacgacttggaaagcgttgcactcgcattccgggagtacggtgaagatattgccggggtcattgttgaaccggtagcaggcaatatgggcgttgttccgccgcaggaaggctttttacaaggacttcgcgacattacggaacagtatggcgcgctgctcatttttgatgaggtcatgaccggttttcgcgtggattataactgcgcgcaagggtatttcggcgtgacgcctgacttaacgtgtctcggcaaagtcatcggcggcggtcttcctgtcggtgcgtatggcggaaaagctgacattatggaacgaatcgcgccgagcggtccgatctaccaggcgggaacattgtctggaaatccgcttgccatgacagcgggacttgagacgttacagcagctcacacctgaatcttaccaagaatttgtgaaaaaaggcgatatgcttgaagaaggcatttcaaaagcagctgcagcacacggcattccgcacacgtttaaccgggcggggtcaatgatcggcttctttttcaccaatgagcctgtcattaactatgaagcagccaaatcttctgatttaaagctgttcgccaagtattataaagggatggccgacgcaggcgtatttctgccgccgtctcaatttgaaggattgtttctctccactgcgcatacaatggaggatattgaaaataccattcaagccgctgagaaagtgttccaggcgatcagccgctgataccgaaaagccgatgcaagcaagacttgtatcggcttttttcaatgcctccattatcatattttcccggattgcggcatacacctttagtgacatctaattgtatggattagatgaaaggaggatatgaacttgccgcataatcaccgattgcaattttctgttgaagaatcaatctgtttccaaaaaggacaggaagtttctgaattactttcgatttcattagaccctgacatcagggtgcaggaagtaaatgattatgtctcaattaaaggatcattagaacttactggcgagtacaacatagatcacagcagtcattttgaagagcttgatagggagctgaggcatgtagaggaagtgagggcgagggaggatggcacggccgagctcattcattgtttcccggtggacatcacgattccgaaaaataaagtgagccacctcaatgatgttttcgtatttattgatgcctttgattatcagctgacggattcaaggatcttaaccattcaagctgatttggcaattgaagggctgcttgaggaatccgagccgaaagagccggagatccctttgtacgtggcgcctgaattttccagagaagaaatgatcaatcttgccggacatcattctgaggacgaaaatgaaccagaattaatgatacgccatgagcctgaaatacctttgactgtatcagaagaagcagcacaagaaacagagaagaacgaggaagaaatcccgcctttactcaggcaggaggaagaagagcaggaaacagccccgattctgagggagcgggaagaagaaaagcaggaaacagccccgattctgagggagcaggaagaagagcaggaaacagccccgattctgagagagcaggaagaagagcaggaagcagccccgcttctgagggagcaggaagaagagcaggaagcagccccgcttctgagagagcaggaagaagagcaggaagcagctccgattctgagggagcgggaagaagaagagcaggaagcaggcccgattctgagggagcgggaagaagaaaagcaggaaacagccccgattctgagggagcaggaagaagcgcaggaagcagctccgattttgagggagcgggaagaagaagagcaggaagcagccccggttttgagggagcaagaagaagaagagcaggaagcagccccgattctgagggagcaagaagaggtgcctaaacctgtttcctttactgagcctcctcctcccgtttccttccagcacgaagaagagccggaagaagctgaggagcctgcaatcatgtcagctgtgaggaatgaacccgtatttgaggatgattcagcagaagtgcaggaagagccgaaagatgatatcgaaccggttttccctgctttcactctgactccgcatgcagaaaaaccaaaaattgcggaacagcccttccttcaaaaagaagagcagccagaggccgagccgcttctccgtcagagcgatcataaggcggcagaagacgaagatgagcctgcggtttttcaagaggagcaggcgcccgtttatcgcgagttcgttccggaacggcaggaagaggagttttacagcgctcctaagctgcttgaagaagaggctcatggtgaagaagggtttgaaattgaggtaaggaagatggcgccgccggaggaggaaaccgggaagcctctcgatttgtcttttcagttttccaaactgccgcctgaggagccggcgcaagctgaacagcctgagccgcttaagcctgaaagaaagaatgaagaagcggcaccgggaaccgagcagaaggaaaatgacaactctcattacttgacaaaattatttacaagggaagaagaaaagttttcaagaatgaaaatttgtatcgtgcagcagcaagatacaatcgaccgggtgtgtgaacgatatgacattacatcccagcagctcatccgaacgaatgctttatcgtttgatgacgagcttgaggaaggtcagcttctgtatatacctgaatataataacagccatgtgtaagcacaaagaggccgtaaaaatgtggtgaatggaatggaagcagtccaatcagtgcttcaggaatacgggctggcggctgagtatattgagcctgtcagcccgcatgtttggaaggtctactcaaactacggcatttttgctttgaaacagctcaagccggcccgcagcagtgaatttacggatcttatgattgagattgaggagaaaggctaccgatcatttgtgccgatctgccgcacgtatgccggcgatttttttgcggggagacagacggagaattcttattatttaatgccttggcttcagtacgatcaggaggaagaacgggatcaaaaacatgtttacctttttaaagaggtcgcgaagctccattctgcgactgtgcgggacatccaaatccggactgaagatatcagcggcttttatgaagcaacgaaaagagattgggaaaatgataagcttgtctatgaacaattcgccgaccgggcggaaaaagagtggtacctttcaccttttgaactgcaggccgttacgtatcttacagaaacggtttccgccgtcaattttgctctggaacgtctggaagaatggtttgacgcggcaaaggatcatgacaagacgagagcggtgatcaaccacggcagtttatcgagccgccactttctgtataatgatgcgggatcgggctttttcacgaatttcgagaaagctgcgctgggccctccgcaaaatgacctgctcggcttttactccagaatgttcagaagctatccgaaagcatgtccggaatgtctggactggttttatacgtatcacaaatcattcccgctccgtgaagcggaaatcagtctgtttctcagctatatggcttatccgtccgccatgtacaaagtgctgaaacggtatcagaccggccaaaggggctctgaaaaagaagagtgcacgcaattattaagagcgttttggcagatgaaaaatgttgagccttttctcatgaaggttcatcagattgagcgggagaaaaaaataaaagcggaaaacgagtcctcttcataacaggactcgtttttttatatccattccaaatgcagggcgcacgctaaaaacagcaggatggcaagcagcaggacatcaaaagtcgtcggaaagaaaatcgtcctgatcccctgaaagatcgtaatcggaataatgacttgcacggatacaaggcggacctgtctggcccactgggggagcgaataagaattgaatttttttctcacgggcaattcctcctcacattcgcctttctatgtatcgtatgtaaggggaagagcggggtgcatgcccatttatgtatgacggcagcggtttttggaaaagatgattgacgaatcaaaaacacttttactataataaagaacataataaataagatcatgagctgatataaatacacctgctttgaacgggaagagtacaagaaagacgcatgaagagagagaagctactgtgctgaaaggcttcttatgccgtctcattggaaggtcgcccgggagcataatttcttgaacatacagtagagaaattcgggccgcacccgttatccgtttaagtgcatgaacaaatctgttcatgaaaaaaggtggtaccgcgaaagagcttttcgtcctttatcaggatgaaggctcttttttagttgctcagccatttctaaacatgctggagggttatcatggatacaaacgaacaaacaatgccgacaaaatatgatccgtctgcgattgaaaaaggccgctatgatttttggctgaaaggaaaatattttgaagcgggcggcgatcaaacgaaacagccgtattctgtcgtcattccgccgccgaacgtgacgggcaggctgcacctcggacatgcgtgggatacgacgctgcaagatatcgttacgcgtatgaaacgcatgcagggctatgacgtgctctggcttccgggcatggaccacgccggcatcgccactcaggcaaaagtcgaagcgaaactccgcgaacagggcacaagccgttatgacctcggccgtgaaaagtttttagaagaaacgtggaagtggaaagaagagtatgctgatttcatccgcagccaatgggccaagatgggactcggactcgattattcacgtgaacgtttcactcttgatgaagggctgaacaaagccgtgcgtgaagtattcgtcaagttgtacgagaaaggcttgatttacagaggcgaatatatcatcaactgggaccctgccacaaaaacggctttatccgatattgaagtgatttacaaagacgtacagggcgcgttttatcatttgcgctacccgttagcagacggttcaggctcaattgaaatcgcgaccacccgtccggaaacgatgcttggcgacacggctgtcgcggttcatcctgaagatgagcgctacaagcacttaatcggcaaaacggtgattctgccgattacaaaccgtgaaattccgattgtcggcgatgattatgttgatatggaattcggatcaggcgccgttaaaatcacgcctgcccatgacccgaatgactttgaactcggaaaccgccacaatttagagcggattctcgtcatgaatgaagacggaacaatgaatgaaaaagcgctgcaatataacggcatggaccggtttgaatgccgtaaaaaactcgtcaaagatcttcaggaatccggcgttctctttaaaatcgaagaccatatgcattctgtcggccacagtgagagaagcggcgccgttgttgagccgtacctgtccacacaatggtttgtcaaaatgcagccgctggccgatgctgcggttgaccttcaggcaaaagaagagaaggttcacttcgttcctgaccgtttcgagaaaacgtacctgcactggatggaaaacatccgtgattggtgtatttcccgtcagctgtggtggggccaccgcatcccggcttggtatcataaagaaacaaaagaagtgtacgtcggccttgaggcgcctgaggacagcgaaaattgggagcaggattcagacgtgcttgatacatggttcagctccgcgctttggccgttttctacaatgggctggcctgatgaaaacgctgaagactttaagcggtattactcaaccgatgtacttgtaacgggatatgacatcattttcttctgggtatcccggatgattttccaaggtcttgagtttaccggcgagcgtccgttcaaagacgtgctgattcacggcttaatccgtgacgagcagggcagaaaaatgagtaaatcccttgggaacggcgtggacccgatggatgtcatcgacaagtacggagcggattccctgcgctacttcctggcaaccggaagttcaccgggacaggatctccgtttcagctatgaaaaagtggaatccacatggaacttcgcaaataaaatttggaacgcctcccgttttgcattaatgaacatggacggcatgacgtatgacgagcttgatctgtccggtgaaaaatcagttgctgataagtggatcctcacaagactgaatgaaacgatagaagacgtgacacagcttgcggatcgttatgaattcggtgaagtcggacgccacctgtacaactttatctgggacgatgtgtgcgactggtatatcgaaatggcgaagcttccgctgtacggggaagatgaagcggcgaagaaaacaacccggtctgttctggcatacgtgcttgaccagacgatgcgtcttcttcacccgtttatgccattcttaacggaagaaatctggcagcaccttcctcatgaaggcgagtcaatcacgatcagctcttggccggttccggtgccggaacatacggataaagaggcagcggcggatatgaaactgctcgttgaattaatccgttctgtccgcaatatccggagcgaagtcaacacgccgatgagcaagcaggttgaactttacattaaaacatctaccgaagacattgccggccgccttgagaagaaccgttcttacgttgaacgctttacgaatccgagcacgctgaaaatcgggacggatatcgctgcggcagacaaagcgatgacagctgtcgtcaccggagcggaagtcattctgccgcttgaagggctgattaacattgatgaggagatcgcccgtctgcaaaaagaattcgacaagctgacaaaagaagtcgaacgcgttcagaaaaaactcggcaacgaaggattcattaaaaaagctcctgagcatgtcattgaagaagaacgcggaaaagagaaagactacacggcaaaacgcgaagctgtccggcagcggattgcagagctgaaaggctgataaaacagcggggcggtttcctaagaaaccgccttgtcgtataaaagaggggatttcattgtttaatacgtacaaagaagcgatcagctggattcacggcagactcaagttcggcgttaagccgggccttctccgtatggaaaagctgatggaaaaactggaacacccggaaaagaacattcgcgccattcatgtggcgggcacaaacggcaaaggatcaaccgtttcttttatccgttccgtccttcaagaagccggttatacggtcggcacgttcacatcgccttacatgattacgtttaatgagcgaatcagcgtcaacggcacgccgattaccgatgaggaatggagaacgctcgttaatgacataaaaccgatagtcgatgagcttgataagaccgatgccggaacggtgacggaatttgaaatcattacagcgtgtgcatttttatattttgcgaagcgggctgatatcgattttgtcatttttgaagcggggctcggcggcacatttgattcaaccaatattgtgaaaccgcttctgtcggtcattacaagtatcggacatgaccatatggccattttaggcaataccatcgaggagatcgccgggcagaaagccggtattattaaaaattccattccggtcattacgggcgtcaatcagccggaagcactcggcgttattgaagcggaagccgaaaaaaagcaggctccgtatcagtcactatataaaacgtgcagactgtttaatgaagcggcgcttccgtccggcgaaagcttttcgctggaaacagaaacgaaatgctatgaaaacattcaaacgtcgctgatcggcattcaccaaaggcagaatgcggcattggcgatattggccgctgaatggctgaatcgcctggaggccgcagtcatttcagaagaagcgatgcgaaacggactgggaaaatcttcctggccgggccggtttgaacgtcttcaaagccgccctttagtgtttgcggacggcgcccataacgaagagggtgttgaaacgctgacagaaacgatccggcagcgctttgccggtaaaaacgtccatgtcgtattcagcgcattaaaagacaaaccgtatcaggaaatgattaaaaagcttgaaaccgaagcggattccattcactttgtatcatttgactttccgcgtgcttcaagcgccgaagccctttacaatgcaagcagtcttgcatctaagagcttcgatgagaacccggacagtgtgaaagaatggatagaacaaaaagacggggcggatgatgtcatcatcattaccggctccttatattttatttcagagatgagaaagcggcttatctgacagcctctcggatgcccggcagaccattttccggttttgccgggtgtttttatgctgaaaatatattttcagccatttcagtcatggtgtttttctttgctataatctgagccagattgatagtaaaggtgtggtctgagtgcttttaattctgttttttctcggcttgattttcggttcttttttttatacagcagcgtgccgtatcccgctgcgaatctcggttatttcgccgcgttcatcctgttcgttttgccgcttgccgctctcctggggggagcttgtgcccgtcgtctcctatattctgcaaagaggcagatgcagaaactgccgtgcgaagctgtcggttatgtatccggcggcggaatgctggacggcgtgtttattcacggctgcaggcattcatttcggtttctcaaaagaactgttagtcgcgctgttatttctgtctctcctcatgattgttactatgacggatctgcaatatatgctgattcctgacaaagttctgctgttttttcttccgcttttcatcgccggccgaatgttttctccgctggattcatggtatgcagggtttgccggagccgtttgcggattttttctgcttgtttttatcatgtttgtcagtaaaggaggcatcggcgcaggtgatgtgaaactgtttggggtgatcggcctgacgctcggcgtgaagctcgtgctcattgcattctttctttccgttatgatcggagcggtatacggtatgtgcgctgcagcccggggcagtcttggtaaaaagcagccatttccgtttgcgccggccatctcagccgggagcgctttgagttatttatacggtgatgagctgttttcgttttacatcaagctcgcttcaggcggggcttgaaaaatttggcgaacgttttttggacaagacgacaaaagtcttgttcttttttttttcgcctatgctaaagtgtgaaccatgatcagttcaaggtacggccaagacgaatgcaagggggaagagacgttgaaaaaaaggaagagcaaaaagcacagcaaagctaaaaacaatgcccttaaagtaaccattaacggacaagaagaaacgatgtatggacaagaagatgtgaatgaaggcggggagaagaccgtcacattttccaattgggaagaaacaaaaaaggcggaacaggagaccgccgcttcccatgaagatccgaaagaagaagatttcaattgggatcatgagaagaattctgaggtatttgaagatgacccgaaagtcgttccgccataccagaagaaaaaaacaggccctcattttccgaaaaaaaagcagccgtcttctccagttaaaaaagcggtcacgacaattgccgttgcggctgttttaggcaccgggctcggccttgtcgccttaaatatgtcgggaagtaaagaagcctccgctccggcatcagctgacaaaggttcacaagggcagacggtgaaagcgggagatgtttctaacgacaaatctgaaacagccggcacaggagatgcggaatcttcagcgggaaactataaaacatatgcggtgcaggccggaaaattttcatcagaaaaaggagcgcaaacgcttgttgaccagctgactgaaaaaggatactcggccgtctctctggcaaaagaagacggatacacatacgtgatcgccgggcttgcagcggaaaaaagcttatcacagcaattgggtcagacactgatagaccatgattttgaggcttggggcggaaaagagctcagctttgcggtcgattcagggctggaagactcttttaaacaggcatctgagctctccgccaaagcgattaccggcaaaaatctttcaaaaacggaagtggctgaagcggcaaaagcggcagacggcgcagacgccgctgacaaaaagcagaaagaggccgtgcttcaagcgctgaaagaactggaaacgtcgggttcggaatccggctggaaagcccaaaaagagctattaagtgttgtaaaatagtatctcatttcccgtcatccggcgggattttttattttgtcatcaaaaagttatttttctgaaattgtggttgcccgtttgatttggtaggatagacaagtatctttttttcttaagcaaaccctgaaaggatgacaaccatgacaaaacgcttaatactcgcatcacaatctccgcgaagaaaagaactccttaatcttcttcagattccttacagcattattgcgagccgcacagaagaaaaattaaatcgaaacctttcgccggaagaaaacgtccaatgtttggccgagcaaaaagctagtgctgtattggccgaaaatcccgatgcagtcgttatcggggctgacacgatggtgtgcatagacggcgagtgcctcggcaaaccgcgtgacagggaagaagcggcacagatgctgcggaggctttccggccgaagccatcaagtcattacggcggtcagcattcagacgcgtgaccggaaagaaacattctgtgacacaacggaagtgacgttttggccgctcagtgaagacgacatacagctctacattgaaacaaaagaaccgatggataaagcaggtgcatacggcatccaaggaaaaggcgcgcttttagtgaaaaaaatagacggtgatttttattctgtcgtcgggcttcctgtcgctaaaacaatgagagccttgaaagaatttaatataaaagcttgatgttcaaaccgggaaggggaacaaggaggggttgatcatccgtgatctgccgttaaaattaagagatttccccgaaaaagaaaaaccgagagagcggcttctgcacttcggagccgaacatctctctaacaatgaattgctcgccatcctgctgcggacgggaacgaaacatgagtccgtcatgaacctcgctcaccggctgctgcggacgtttgacgggctgcgcctgttaaaaggcgcctctgcccaggagctttccagcattccgggaatcggaacggtgaaggccgttcagattcttgccgcaattgagctggggagccgcattcataagacatccgccggggagcattgcgtcatccgctctccggaagacggggcgaagtatgtgatggaggatatgcgctttttaacccaggagcattttgtctgtttatatttaaataccaaaaatcaagtcattcataaacgcaccgtttttatcggaagtctgaattcatctattgtccacccgcgggaggtgtttaaagaagctttcaaacgatccgccgcgtccttcatttgcgttcataatcatccttcaggagatcctacaccgagcagggaagatatagaggtaaccaggcggctttttgagtgcggaaatttaatcggcatcgagctgctggatcatttggtcattggtgataaaaaatttgtgagtttaaaggaaaaaggatatttgtaacactttttttttcgttgatttaagatataatagattttatgagtttttccctttagggtatttttgctttaagaaaggaagatacatacatatgttcggaattggtacaagagaccttggtatagatttgggaaccgcgaatacgcttgtgtttgttaaaggtaaaggaatcgtagtgagagagccgtctgtcgttgctctgcaaacggatacgaagtcaatcgttgcggtcggtaacgatgcgaaaaacatgatcggaagaactccgggcaacgtggttgcgctccgtccgatgaaagacggcgttatcgctgactatgaaacaactgcgacaatgatgaaatactacattaatcaggctgtgaaaaataaaggattgtttgcgagaaagccgtacgttatggtgtgtgtgccgtcaggtattacggccgttgaagaacgggcggtcatcgacgcgacaagacaagcgggcgcacgtgacgcttatccgattgaagaaccgtttgcggcagcaatcggtgcgaatcttccggtatgggagccgacgggcagcatggtcgttgatatcggcggcggaacaactgaagtggcgatcatttctttaggcggcattgtcacgtctcagtcaatccgcgtagccggtgacgaaatggacgactcaatcatcagctatatcagaaaaacatataatctgatgatcggtgaccgtacggcggaagccattaaaatggaaatcggttcagcagaaaccggtgaagaaaatgcgtcaatggaaatccgaggccgcgatcttctgacaggtctgccgaaaacgatcgaaatcacgggaacggaaattgcaaatgcactgcgtgatacagttctctcaatcgttgatgcggtgaagagcacgcttgaaaaaacaccgcctgagctggccgctgacattatggacagaggtattgtattaacagggggaggcgccctgctccgcaatctcgacaaagtcatcagcgacgaaacgaaaatgcctgttcttatcgctgaagatccgctggattgtgttgcgatcggcactggaaaagcactggagcacatccatcttttcaaaggaaaaacaagataatcaggagttaaatagaagaggtgtatcacgatgccgaacaaacggttaatgctattacttctgtgtattatcatattggtggctatgattggattctcgctgaagaacggccgtaataccacctggcctgaaaagctgatcggtgatacgacgggagtatttcaaaacatttttcacacgcctgccgaatattttgcagggttcttcggggacataaaagacctgaaaaacacgtacaaagaaaacgaacgcttaagacaaaagctggacggacagacacaatatgaagcgaagctccaagaactcaaagatgaaaacaagaagctgcgtgatgaactcgggcatgtcaaatcaatttccgactatgatccgattttagcgaccgttatcgccagaaaccctgatcaatggtacaagcagatcatgatcaataagggaacgaagcacaaagtggccaaagacatggctgtcacgaacgaaaagggtgcgctggtcgggaagatcaaaagcagcggactcaacagtttcacatccgccgttcagctgctgagcgatgttgaccgcaataacagagtggccaccaaaatctccggcaaaaagggaagcaaaggctacggtttaattgaagggtatgataaaaagaaacagaccctgaaaatgaccatccttgaaccggatgaaaaacgtgaagtgaaaaaaggcgacctcgtggagacctccggaacgggcggcgtatttcctcaagggctgacggtcggcgaagtgaccgatgtagaatcagatgcttacggcctgacgaaaatcgcttatgtgaaaccggctgccgacttgtacgatcttgaccatgtcatcgtcgtgaaccgaagcgtagcaacaggggaggaaggatcgtgaaacgtttccttctccctttgattatgattttggtcttttgtgcggaaagcatctataccgatctggtgcgttttcctttcgtttccgtcgagcagcaggtcgttccgcattttcttttgcttgcgctgatttttatgtcggcttatatcaaccaaaagcatgcggtgatctacggtttcattttcggatttctttatgacatcaattatacgggtgttttaggcgtttatatgtttggttttgccggattatgctatctggcggccaaagcgtttaaagtgctgcagacaaacgccctgatggtcattctggtcgcggtgctgagcgtatgtgtgcttgaattttacgtctacggcattcagacgttaatccgcagcggcactatgacgtttaacgattttgtcattcagcgattcttgccgaccgctttgctgaatatcgcgggagccgttatattagtcctgcccttcaggctgttttatataagtctgaagaaagaattaagagatgagtaaaaaggattttatctttttttgacgaaaagagtatgttgttgaggtgaacattgatgaagaccaaaaagcagcaatatgtaacaataaaaggaacaaaaaacggcttaacattgcatctggatgatgcgtgttcttttgatgagctcctcgatggtcttcaaaacatgctgtcgattgaacaatatactgatggcaaaggccaaaaaatcagtgttcatattaaactcgggcatcggtatctgtatcaggaacaggcagagcagctgactgatctgatcgcgtcaaagaaagatttagtcgtgcattcaattgacagtgaagtcatcgccaaagaagaagcgcagcggatgaaagaggagcaggaaattgtttcggtttccaaaatcgtccgttcgggccaggtgcttcacgtgacgggagatttgcttttaatcggagatgtgaatcccggcggtacgatcagagccggaggaaatatatttgttctcggttcattaaaagggattgcccacgcgggttataacggaaataaccgggctgtgatcgccgcatccgaaatgatgccgacacaattgaggatcaatcacgtgttaaatcgctccccagaccacattcaaaaagggaacgacatggaatgtgcttatttagatactgacggaaatatggtcattgaacgccttcagcaattggctcatttaagacctgatctaacaaggcttgagggaggaatgtgaaattgggtgaggctatcgtaataacttcgggaaaaggcggagtaggtaaaacaacaacatctgcaaacctcggtaccgccttagccattttagggaagcgcgtctgtttggtagacacagatatcggactgcgcaaccttgatgtcgtaatgggtcttgaaaacagaattatttacgacttagtagatgtaattgaaggccgatgcaagacgcatcaggcgcttgtcaaagacaaacgttttgatgatctgcttcatttaatgccggctgcccagacaagcgacaagacggctgttgtccctgagcagatcaaatcgcttgtgcaggagcttaagcaggaatttgattatgtcattattgattgtccggcgggaattgaacaaggctataaaaatgccgtctccggagctgataaggcgattgttgtgacgacgccggaaatatcagcggtgcgggacgctgaccgcattatcggacttttggagcaggaagatatcgaaccgccgcgccttatcgtgaaccgtatcagaaatcacctggtgaaaaacggtgacacgatggatgtggatgaggttgttcatcatctgtctattgatctcctcggaatcgttgctgacgatgatgaagtgatcagggcttcaaatatcggcgaaccgattgccatgaattccaaaaaccgcgccagcattgcgtaccgcaatatcgcccggcgcattttaggagaatccgttcctttgcaggtgcttgaagagcagcaaaaagggatgatggcgaaaatcaagtcatttttcggcgtgcgttcataatatataccagaatacaaagatctgatgaagcccagcttatcaggtcttttttgttttttaagagcgcatatttgcaatggacaagacataggatgtacaaacccaacgattgcaaaggatgatggcgatgagtcacagagctgatgaaattagaaaaagactggccaaaagaagaaaacagcggcctgaatcaaaacggactttcgttcaaaacgctcaaacgcagaattttcccgcgtggcagacggtcaaggagcaggaaaagcacaagcttcttccggactacgaatatcaaacggaacacccgcccgaatttaacgggcggcatccattgatcagcgctcattctattattttaaaatgcctgctggccgcctgtctcgtactgatctccgctattgcctataaaactgacaaacagccgctgagtcagatcaaaccggcaatcgcacaaacctttcaaaaagaatttcagtttgctgccgtaagcaattggttcgtatcttccttcggaaacccgctcgcttttcttacgccgggaacgaaaaagaaggacggtcaggtggcggtcagtcaggatatggccgttcctgccgcggggaaaatccagcaggactttcaaaataacggagagggcgtcgtcgtcgaaaccgccagtgaagccattgacagcgtaaaagaaggctacattatggaagtgagcaaagataaaaaaacagggctgacggtgaaggtgcagcacgccgacaatacaagcagcatttacggccggctgaaagatgttaacgtttcattgtacgattttgtcgataaagggaaaaagatcggttcgatcaagctcaacgataaaagtaaaggccagtactatttcgcgatccaggatggcgataaattcatagatccgatccaggtgatcacatttgatgaataaatggctcatcctcctttttaaaattcatgtccatccttttctttggattatcatggggctcggtcttatgacggggcacatcaaagcgctgctgtgtcttttgctggtcgtatccgttcatgagctggggcatgctgctctggctgtgtttttttcgtggcgcattaaacgcatctttctgctccctttcggcgggacggttgaggtggaggagcacggaaaccggccgcttaaagaggaattcgcggtcattttggcgggcccgcttcagcatgtgtggcttcaggcggcagcctggctctttttcacgtcaggttttgcaagtgagcagacatttgagatgtttaccttttataacctctccattcttttcatcaatcttttgccgatctggccgcttgacggcggcaagttcgtgtttttatacttctctaaacaaatggcttttcaaaaagcgcatctcctcagcctgcagacatcggccgtttccgcgcttttgctctgctgctggattgtgctggccgtcccccttcaggtcagcgcatgggtgctgttcgtctttctcgccgcttctttatgggatgaataccggaagcggcattatattcagctgaggtttcttttggagagatactacggcaaaaaccgcgatgtcgccatgctgcatcctttgacggtcgcggccgatgccaaagtaaagcatgtcatggctgaattcaaacggggatgcaagcaccccattatcattgaaaaagccggcgaaaagctcagccagctcgatgaaaatgaagtgcttcatgcgtattttgccgataaacggacagattcctctatggaagacctgctgctgccttactagaaatagattgacatatccttttggttctgatatattttttaatgttatggatgtagcaccaatgctacaaccgctcgggacaggtgataagagctttaaagccccctgttgctggcgagtcttagtctaataggaggtgcagagaatgtacgcaatcattaaaacaggcggaaaacaaatcaaagttgaagaaggtcaaactgtttacatcgaaaaacttgctgctgaagcaggtgaaacagtgacgtttgaagacgtattgtttgttggcggagacagcgtgaaagtcggcaacccaacagttgcaggcgcgacagttacagctaaagttgaaaaacaaggccgtgcgaaaaaaatcactgttttccgttacaagccaaagaaaaatgttcataaaaaacaaggtcatcgtcagccttatactaaattgacaatcgaaaaaatcaacgcgtaagcatgattgaggcaacaattcgaagatcccggaatgacgggggcattttgtcctttgaaatgacgggacatgccgattttgctgaacatggacgagatctcgtttgcgccggggtcacggctgtcgttttcggagcggtcaatgcggttatcgcgctggctcctctcgaaccgattcttgatataggcgaggacgggggttatttctattttgaattccctgaagccgctgatcaggaagctttgcaaaaagcgcagctgctgattgaaggcatgattgtttctcttgaaacgatcgagcgggattacagtgaacacttacggttgactgcaaaccaaatataggaggtgagttacatgcttagattagatcttcagtttttcgcttctaaaaaaggtgtaggttctacaaagaacggacgtgactctgaatctaaacgtttaggcgctaaacgtgcagacggtcaattcgtaacaggcggatctatcctttaccgtcaacgcggaacgaaaatctacccaggtgaaaacgtgggccgcggaggagatgacactctttttgctaaaatcgacggaactgttaaattcgaacgtttcggccgtgaccgcaaaaaagtgagcgtatatcctgtagctcaataatgacacaaaaaactccggtcgttgactggagttttttttgcagtaagcggagtaacatcaagaatgaaaagcagaggatgcgtgagtgaaccccgccttgaatgaggacatcagcttctcatacccactggatatgttccccaagcagtgataccaaaaatgtttctgcctggcatccgcattgtatgcgatccgaaaaaggaacatgatgaaccaggaaaaacaagtgtttttttaacaaagccttctctgttataattcatagtacacacttatcaagactcctaaaaagaaattaaacgattgggagtgcgaaaatgaaggatgtatcgaagaaacaagaagaacctgtaagcgatgcggctctgatcaatgaactgatccaattaatgggccatttccgtcatgattggatgaataagctgcagctgataaaaggaaacttaagtttgcagaagtatgacagggtcgttgaaataatcgacgaaatggtcatagatgcaaagcacgagtcaaagctctcaaacctgaaaaccccgcacttggcgtttgactttctgacatttaattggaagtcccgttatatgaggctcgaatacgaagtgctcggagaaattaaagatttatcggcatatgatcaaaagctgtcgaacctgatgagaaaactgtttcatctgttcggtctggcggtaagcaatgaaagtgaaaatcatctgaccgtatcgctgcagacggatcaccctgacagacagcttattgtatatctcgattttcatggaacgattgcaaatgcagatgtgtttgatgaatttcgcaaatcccggtatgaggactttgatgtcatgcaatttgagctgaccggccatgaatgtgtggccgaaattggaatgaactagcggttttttacggtttagaacggaggatattatgtttgtagatcaggtgaaagtatatgtaaaaggcggcgacggcggtaacggaatggttgcgttccgccgtgaaaaatatgtgccgaaaggcgggcctgccggcggtgacggaggtaatggaggcgacgtcgtttttgaggttgatgaaggactgcgcacgctcatggacttccggtaccagcgccatttcaaagcgatacgcggcgagcacggcatgtctaaaaaccagcacggcagaaatgcggacgatatggttgttaaagttccgcccggcacagtcgtaacggatgacgatacaaaacaggtcattgccgatctgacagagcacgggcagcgcgccgtcatcgcaaaaggcggacgcggcggacgcggaaatacccgctttgcgaccccggccaacccggcgccgcagctgtcagaacacggagagcccggaaaagagcgctatatcgtgcttgaactgaaagtgcttgcagacgtaggtctcgtcggcttcccgagcgtcggaaaatctacgcttctgtctgtcgtttcatcagcaaagccgaaaatcgccgattatcattttacgacgcttgttccgaatctgggcatggtggaaacggatgacggaagaagcttcgtcatggcggatctgcccggtttgattgaaggagcgcacgaaggagtcggcttaggccaccaatttctccgccatatcgaacggacgcgcgtcatcgttcacgtcattgacatgtcagcgatggaaggccgtgatccgtatgaggattatgtgaccattaatcaggagctcagtgaatataatctgcggctgacggagcgtccgcaaattatcgttgcgaataaaatggacatgcccgaagcggctgaaaatctaaaagcgtttaaagaaaagcttcaggatgaccatcctgtcttcccgatcagcgcggtgacgagagaaggactccgcgatcttctgtttgaagtcgccaaccagctggaaacaacgcctgaattcccgctgtatgatgaagaagaactggcggaaaaccgtgtaatgtacacgatggaagatgaagaaattccatttgacattacccgtgatccggacggcgcgtttgtgctttcaggtgacagtctggaacgtctctttaaaatgactgacttctcccgtgacgaatccgtcaagcgttttgcaagacagatgcgcggtatgggcgttgatgaagcgctcagagaacgcggtgctaaagacggcgatatcatccggctgctggaatttgaatttgaatttattgattaaaaagacggagagcttgcaatgcaggctctctgatgtaaaagggaggggtgcaggtgaaagaagagacattttatttagtgcgtgaagacgttctgcctgatgcgatgcggaaaacccttgaagtcaaaaagctgctcgacagaaaaaaggctgaatcggttgcagatgccgtgcagaaagttgatttaagcagaagcgctttttacaaataccgagatgcggttttccctttttacacgatggttaaagaacaaataatcacacttttctttcatttggaggatcggtcaggcgcgttatcccagcttttgcaggcggtggctgactcaggaagcaacgtgctttccattcaccagacgattccgcttcagggcagggcgaatgtcacgctctcaatcagtacgtccgcaatggaagaaaacattcatacgttaatgaataaactgagaaaatttgattttatagaaaaagttgagatcttagggtcaggcgcgtaaggagagaagagacatgaaagtcggttatttagggccagaagccacatttacacatctagcagtcagttcctgctttcaaaacagcgtgacacaagcaccttatcaaacaataccggcatgcatggatgcggcggttgcgggagaagttgatcttgcatttgttcctttggaaaacgcgctggagggctcggttaacttaacgattgactacttgattcatgagcagcctcttgcgatcgtgggggaaatgacgctgccgattcaccagcatctgctcgttcacccttcgagagaaaatgagtggaaaaagcttgagaaaatttattctcattcccatgcgattgcgcaatgtcacaaatttcttcaccggcatttttcgtccgttccttatgagtatgcgaagtcaacaggtgcggctgccaagtatgtcagtgagcattcggaccttccgatcggcgtgattgcaaatgaaatggcggccgctacatacggattgagcatcgtgaagcgggatattcaggattatcaggacaaccacacgagatttgtcattctttcgcctgaaaaagacgtctcattcgaagtgaatgcgaaactgtcttcacggccgaaaacgacgatgatggtaacgcttccccaagatgaccaatcaggcgcgctgcacagggtgctgtccgctttttcatggagaaacctgaatttatcaaagatcgaatcgcgcccgaccaaaacgggtctcggcaactatttctttattattgatattgaacaggcgatggatcaggttctcattcccggtgccgttcaagagatggaagccctcggctgccgggtcaagcttctgggaacatatcaatcctattcgatataaaaaaagctccccttcagggggctttttttttaatcttttattaaaatacccgcgtcgtccagcgcttgacaggcttggtcaatccgctcttttgtcggggcgcttaacgtatggagatgcacgcctccggtcagctgtgaaaggtaagcggcatttgtcgagttaatgtgatccatgaattgtttgacttctttccgtgtgctgactcttatggcggcggttaaatcgccgtatacggggtgttcaataatgacgtcctttatggtgacgccttcatcgacaatgagttcaagctcttcttccgtccgctccgggccgtgcagacaggcgacaatccgttcggcgtttttttcgccgccggcattcatgctgatgtataaatagccttggctcgtcgcgataatcggttcgctttttgctttcaagagcgatatgtcctgcacgatcacctgtcttgaaacatttgcttttttggccaattcgcctcctgttaatggcgagccggcttctttcagccaatgaagcagcatgtcgcgtcttttcgccccagtaagcttcgttccttctgtcaaattgctgattctcctttcttttgctcccatagcgccgtaaatgtatgtatcagcatatcgagctgttcacatgttgtttcgtttccgaatgagatccggaaaaactgccgcgcttcccgttcggtttttctcagcgccttcatagctgaagaagggccgtggctgccggcggaacatgcgctcccggttgagatgcaaatatcgttacgattacattctaacataatatattgtccttcaaaggagtgaaaaaaacacccgacaatgtggggcaggcattcaccgccggtttcttcctctgaaaatgaaatggggaggccttgacgcctaatttggtcatacaaataattcctcagcctgtcagcatgctcacggtgttcctccatatgtttcactgcatactccgcagcagcggtaaaagcgccgatggccggcacattcaccgtaccgggcctgaacccgttttcatgcacggtatgcggataaaccggattccagctgacacccggccgaatgtaaacagccccggtgcctttcgggccgtatactttatgaccggagacggaaagggcgtcgattcccgcctgatccgcatcaatcggcagtttgccgaaactttgaacacaatcgcaatgcagtaaaatgtttctctggtgaagaaaagcggccagacgattcacaggctggatgaggccggtttctgaattggcgtgctgtatggaaacgagccccgtgtcaggacggatatgagccgccagtatgtcctcggttataaggccgttttcgtcgggatatatgatggtgacatcaattccccggtcagctaaaaacgccgcggcattatggatcgagtggtgttccattgcggtcgtaataaaatgttttttatgatcgggcagaccgtacagcaatgattggacggccaagatgttcgcttccgttccgccgcttgtaaagtgaatgccgtctgccgctccgccgatcaattttcctgcagaatgtctgcaatattccagcacgtccgccgctcttcctccggcgtcatgaaggctgctagcattgccgtatacctctgtgctgagatgctgaaagactttcgcggcttctttgcttaaaggcgttcccgccgcgtaatcaagataaatcatacagcccgtctcctatccgtttatgttaaaaaaagcttgagtttattttatcgttgtgtaaatataggtgtcaagacaggtgtaaatataatgggagggtgatgtatgtctgaaaaaacaattatcgtcattggtacggggacggcggcccttgcctgtgcttcctcatttcctccgtcataccaagtaaccgtcatcacaaagagaaacgtaacgaacagcaattcgtattatgctcaaggcgggattgctgtttcatacgcaaaagatgactcgatagaatcccatgtgaacgatacactgtatgcgggatgcggacacaatgacgtgacagccgtgcggcatttgctgcaaagcggacagagcatgataaacaggctgatagaaggccttttcccttttgatacgaagtcggacggaacgttttgtctcggcagggaaggcgctcattccaaaaggaggattctgcacgccgggggagatgcgaccggacggatgctggttgagtttctggttcggcagctgagggacggcattcggatcattgaacacgagacggttgttgatctgctgattgaacacgggcgatgcgcaggcgttgccgtaaaggatgcttcaggtgccgtttcttacagaagagcggattgtgtagtgcttgcttcaggcggctgcggcagtctgtaccaatatcacacaaatgattccgccataacgggagacggcatcgctcttgccttccgcgcgggagctgagatcacggatatggagttcacccagttccacccgaccctccttgtgaaaaacgggactgtttacggtctgatttctgaagcagtgagaggagaaggcggatatttagcagatcgcttcgggcgcaggatcatggctggcagacacgcgcttgaggatttggcgccccgggatgtggtttcacgggcgatttatgaagaaatgatgaaagaaaatcctgtttttataaattgcagccgaatagccgattttaacaaacgttttccgaccataacagaaatttgtcaaacagccggcgttgatcttgaaagcgggatccccatagcacccggaatgcattttttaatgggcggagtaaaagccgatacatgggggaaaacgtccgtgcctgatttgtacgccataggcgagaccgcctgcacaggcttgcacggggcgaaccgccttgcgagcaactcactgctggaagcgctggcaagcgggcaacgatgtgctgaacatatcattcaaacaccgttaaacggaagatataaaaaaaccccgaagaaaactgatgtcatcttacaagtgccggacacaacgattcatgtgcttcaagccaaaatgacaaccggagcgggtatcgtcagggaaaaagaaaacctgcaggcgctgacatcctggcttaacaacgtatctgtgcatcatataaatgtgaaggatatcacaatggaacaagcagagctatcctgcctatggaagactgcgcaacttgttgtcacctcagcccttattcgggaagaaagcagaggcgctcattttcgtactgattttcccgggacggagaaagattggcacggaaaacaaatcattcattcaacatctggaacggttatcagaaaaaacgaaaggattggggaactatggacattctgcagctgaaacaaatgctgactcatttttttcaggaagatatcggaacgggtgatgcgacgtcacaagcgattttttctgatcagcaatgtaaagcgcggatcatcgcaaaaacagacggcgtgtttgccggagaagacgttatccgtgaaggatggaagcttttacacgatgatatccgcatccgccctctgaaaaaagacggagaacggatgaaaaaaggagatgtgctcgctgaaatggaaggccgggcggcagctcttcttactggggagcgggtcattctgaatctcatacaaagaatgtcaggcattgcgacaatgacggacgaggctaaaaggcgtcttgatgatccgtccattaagctttgtgatacgagaaaaacgacaccggggctcagaatgctggaaaaatacgccgttcgggtcggaggcggctttaatcatcgcttcggcttatatgacggcatcatgattaaagataatcatattgccgcctgcggatcgataaaggcggccgtggagcgggcaagagaaacggcagggcagatgcttgcggtggaagtcgagatcgaatccgaacagcagctgctcgaggcaatagaagcgggcgcagacattattatgtttgacaactgtccgcctgagtccgtccggcgttttgcaggcatgacaccgggccatatcaaaacggaagcatccggaggcataacgctcgacacattgcccgcttataaagggacgggcgtccaatatatttcactcggatttctgactcattcagtaaaaagcgccgacatcagcatggatgttgaggctgcggaacagggggatttttaagatgtctatttttgacgtgttaactgcatcagccgaaatgatgccgagccattataaagacatgagcaccggagaaatggaaaagcgtgtcgccgccattaaacgggatttcggaaagcgcctgttcattccggggcatcactatcaaaaagacgaagtgatacaattcgccgatacggcaggtgactccctgcagcttgctcaagtggcagaaaaaaataaagaggcggaatatattgtgttttgcggcgtgcattttatggcggaaaccgctgatatgctgactgatgataaccaaaccgtcatattgcccgacatgcgcgccggatgctcgatggctgatatggcagatattcagcagacggacaaagcatggcaagagcttcaagaactgtacggtaacaccatcattccgttaacatatgttaactcgacggcggaaattaaagcattcgtcggtcggcacggtggagcgaccgtcacctcttcgaatgcccggagtgtgctgaaatgggcttttaaacaaaaagaaagaattttatttttgccggatcagcatttaggcagaaatacagcctatgacctcggcattccgctgacagaaatggctgtatgggacccggggcagaaccgattgcttactgaccatccggaaaacattaaagtcatcctttggaaaggacattgctccgtacacgaaaagtttacagcggaaaatatttttcagctgcggcagcgggattccggcatccgcattatcgttcatccggaatgttcgcgggaagtggtctcgctcagtgacgacagcgggtctaccaaatatattattgatacgattgaacaggcagaaccgggaagcaagtgggcgatcggcacggaaatgaatcttgttcagcgcctcattcactcgcacccggataaacagattgaatcattgaatcccgatatgtgtccgtgtctgacaatgaacagaatcgacctgccgcatttattgtggtcgcttgagcagcttgaaaaaggcgagccgaagggtgtcattaaagttccggaagcggttcggacagaagcgcttcgtgctttgaacagaatgctgagtcatacgtaatcataaaaatttcccctccttcccaaattttttatcatcatgcccagtccaccggcatatagtgtgaagaaacgtattgtaatgacaaatgtaccgttcacgttttgtgcataggaggggaaaacgttgaaaattcatatcgttcaaaaaggcgattcgctctggaaaatagctgaaaaatacggagttgatcttgaagagttaaaaaaactgaatcatcagcttagcaatccagacttaattatgcctggaatgaagataaaggtgccttcagaagccgttccggtcagaaaagaacccaaggccggcttcggaacgtctgcgcataagcatgagcatccatatgccaaagaaaaaccgaaatcagttgtggacattgaagacaccataccggaagaaccgaagccgtcaattccgtatgtgccgccaatccctgaaaagcatgaaaatgtgctgccggaagctgatatgaaccaatattatccgtccaatcagctgtttcagccgtggtcgcctcctaagccggaggaaccggtgacacattttgtcgagccgaaagaaaaagagcatgacaataacattccacaacaggaggaaatgatcaacatggaaaacgcgaattacccgaatatgccgaaggcgcctgaagccggaaagatggaagaagaaaacgccgcttatcatctgccgaacatgccaaacattccgaatgtcccgtttccgaatatgccggccgttgaaccgccttttatgcattacccgatgccgtgcatgccttgtccttgtccggttccggtgacaccgatgctgccgggttcgggactatgccatccgtgcttcccggtaggcggaggtttcggcggttttggaggaggttatggaggctttccggtaatgccgatgccgttaccgtacggattccatcatcacggattccatcatccgggatttgggccgcaagcgggttacggtgaatatgaaaaccaggcccatgaaaatgcagagcattatgatggttctgcatccggtttcggcggtgctccgtacggtcaaatgccgtattacggcggatattcgtctcattacgcaaacgcgcctcatcatgatgggaaatttaaggatgatgattgcggctgccatgattcacatcaccaccaccatcatcaccacggttcacatcaccatcacgcaaatatgcctgtgcagccgtatccgaatgtgggtgcaaacgccggatattttatgccttacggcggagcaaatcctaatgccgcaccgaatcagccgagtccaaatcaagtattcggacggccggaggaagaagaagattaatgtttcgggacgatgtatgtcgttcctttttttatgtccaactgaggaatggacataactgacaagcttaaacccgccgtcggccgcacatcctaaacatgagcggaaaacgctcaaacagcgatgaatccacgggggtttttccattgggtaaaaaactgatgacgatcgcaggcgttttagccgtgacggcaagcttaacggcatgcggagcaaataatgccatgaatgacggacgctacaatcagtcaacacgtccggtcggatattattcgaatgataatgataacggcagacgccagtacggaatggaccatcaaggacccgtttctgaaatgatggaaaaccgaaacggccgtcataatacgacaaacgtgtctgaccagtatgcgcctaatgacggggttccgttaacgacggacggcacatataacggccgaaatgtcaatacgccgccggcagctatgtcttataatgggtatgacaacgccgaaaacatcaggctggcggcaaaagttgcaaaccgcgtgaaaaaagtaaaaggcgtacaggatagtcaggtcatcgtgactgacacgagagtcgtcattgctgtcagaacaaatcatccttttacgaaaaatgatgataaacatgtcaaacatgcggccaaaagatttgcggacggccgtacaattcaagtgtttaccgacaacgctacttttacaaagctgcaagacatgaacagaaacagccgttaaacgggactgccggatgatttcatccggcagtatttttatggataaagcttcatcatttctttacatattcttaaaacgctctttatgttgcggtgttaacataaaagtaataaaacgtaacggaggggccggaatgaaaaaaacggagcatgacaaaagccgcggagaaaaaactgtgtatctgaccgtaaggggataccggctcaaactgacgtccggacaaatgaaactgatttcagccggccgggcataatcatcggggcagccttcataatagaggctgcttttattcggctgaaacagacaaatgaaagaaaacggttaagcaccggcatctttggtcaaactagcatcaagagtttgattgaataaagaggtgttattggtgaaacgaatttgcggtgctcgtctattgtttatgcttatcttatcggctgcagtcctgatttgcggaggaaaaggcgcatacggggcggaggttgagcattacgggccgcttcgggtgcacgtccagctggaaaaggtctatctggacggtgatgtcggcatcgaacatacggatgaaaccgttttggcgatggaggatttttgggccgcatatgcgggctggacgctcgttgagcagaaaaaaggcttcgttcttttccgtaagcatgttgatgacatttctccgctcagtaaggttaacggttatatcggcgtcacggacggaggcgtcatctccacttttcacggccgtcccggatcgctggccgagccgatccaatctttcttccagattgatatagaaaggctggaaagccgattgcaaaagcacttggaacacggcataccgtacaggacaaaagcggagtttgagagcgtgatcgatcatattaagacttacagcggatgactttgacgcaagacatgtgacacatgtcttttttttctgaatggaagatgtcaaagcgaacatacgttaacttttctataagactttggctgtttttgtgttacaatgataagcagtcaaagaggtgaataggtgtgattgaattcgtgaaggggacgattgattatgtatctccccaatacatcgtgattgaaaacggcggaatcggctatcaggtcttcactccgaacccgtttatttataaggtaagcaatcaagagaccatttttacgtatcatcatataaaagaagacgccttttctttgtacggtttttcaacccgggaagaaaaagcgcttttcacaaagctgctgaacgtcaccggcatcgggccgaaaggggcgctcgccatcctcggttccggtgaccccggagccgtcatcgaagcgatcgaacaggaagatgaagcctttttggtgaaatttccgggtgtgggcaaaaaaacggcgcggcagattattcttgatttgaaaggcaaactggccgacgtcgtgcctgaaatgattgacaacctgttcaatcatgaagcgcgcattgaaaaacaagaggctgaaacggcgcttgacgaggcgcttgaagcgcttagggttctcggctacgccgaaaaagaaattaaaaaagtgcttcctcacttaaaagaggaaacggcgctttcaacagatcaatatgtgaaaaaagcattgcaaaaattattaaagtaaggtgatgttcatggatgaacggctcgtttcaagtgaagcagacagccatgaatcaataatcgagcaaagcctcaggccgcagaatctcgcccagtatatcggccaaaagaaggtgaaagaaaatctgcgcgtgtttatcgatgcggcgaaaatgaggcaggaaacgctggaccacgttcttttatacgggcctccgggtctcgggaaaacaacgcttgcgtctatcgtggccaatgagatgggggtggagatgcggacgacgtcaggtcccgccatcgaaagaccgggagatttggcagccatcttgacggcgctcgaaccaggggatgtgctgtttatagacgaaattcacaggctgaaccgctcgattgaggaagtgctgtacccggcgatggaggatttctgccttgatatcgtcattggaaaaggcccgtccgcccgctccgtccgtctcgaccttcccccttttacgcttgtaggagcgacgacaagggtcggattattgaccgcaccgctcagagaccggttcggggtgctgtcgcgtcttgaatactatacgcaggaagagctgacagatatcgtgtcaagaacggctgacgtttttgaagtggatatcgaagaagctccggctctggagatcgccagacggtcaaggggaacgccgcgggttgcaaaccggcttctcagaagggtgagagattttgcccaggtgctcggcgacagccgcatcacggaagaaatcgctcacgacgcgctcgaacgtcttcaagtcgatgcgctcggccttgaccatatcgaccataagctgctgatgggcatgatcgaaaaattcagcggaggtcccgtcggccttgatacgatttccgcgacaatcggcgaagaaccgcatacaatagaggatgtgtacgaaccgtatctgctgcagatcggatttctccagaggacgccgaggggacgggtcgtgactccggctgtgtatgaacattttcgattggaggcgcccgcccgtgactgactttccgaaggttctcatggttctcggtgccgttttgcttattgccggcgcagtctggcactttgtcggaaggctgcccggagatattttcgttaagaagggaaatgttacatttttctttcccgttgtcacttgtattgtgatcagtgtgatactatccattctgcttaattttttcggcagaatgaaataacaatagacagaataaaggtgaaatgatgaaagtcgatttatttgattttgaactgcctgaacgcctcattgcccaagtgccgctgaaagaacgtgacgcatcgcggctgatggtgctcgacaaacagacgggcgggctgacggacagttcatttaaagagattgtaagcttttttaatgaaggggattgtctcgtcttgaacaatacccgtgtgctgcctgcaagattattcggcacaaaagaagatacgggagcgaaagtggagcttctgttattaaaacaggaagaaaatgatacatgggaaacgctcgtaaagccggcgaaacgcgtaaaaaaaggaacggtcctgacatttggcgacggccggctgacagcggtctgcacggaggagcttgatcacggaggcagaaaaatagaattccggtatgacgggattttttacgaagtgcttgaatcactcggtgaaatgccgctgcctccttatattaaagagcagcttgatgataaagaacggtatcagaccgtcttttcaaaagaaatcggatctgccgcagctccgacggccggacttcattttacggaagagattctggacgagctgaagcaaaagggtgtgcggattgaatttatcacacttcatgtgggactcggcacattccgcccggtcagtgcggatgatgtggaagagcataacatgcacgcggaattttatgaaatgacggaagaaaccgccgcctctttaaacgaggtcagaaaggcgggagggcgcatcgtgtcggtcgggacgacatcaacgcgcaccctggaaaccattgccggcgagcatgacggcgtatttaccgcttcaagcggctggacgtccatattcatttatccgggatatgaatttatagcgattgacggcatgatcaccaattttcatctgccgaaatcttcccttatcatgctcgtttctgcgcttgccggcagagagcatgttctttccgcctaccgtcatgcggtagaagaggaataccgtttcttcagctttggcgacgccatgctgattatctaatttgaagacaggaggcctcatacaaagtggctgaacaaccgatacgttatgaatttataaaggaatgcaaacaaacgggagcgcggctgggcagagttcatacgccccacggctcctttgagacgcctgtatttatgccggtcggcacgcttgctacggtaaagacgatgtctccggatgagctgaaatctatggatgcgggcattattttaagcaatacgtaccatttatggctccgcccgggacacgacattgtaaaagaagcgggcgggcttcataagtttatgaactgggaccgcgcgattttaacagattccggcggttttcaggtcttttcattgagcaagtttcgtaatatagaagaagaaggcgttcatttccgcaatcacttaaacggagacaagctgtttttatctccggaaaaagcgatggaaattcaaaacgccctcggctctgatatcatgatggcgtttgatgagtgtccgccgtatccggcagagtatgattacatgaaacgctctgtggaacggaccagccgctgggcggaacgctgcctggaggcgcacgggcgctcagatgagcaggggctgttcggaatcgtacagggcggagaatacgaagacctgcggacacaaagtgcaaaagacttggtttcgcttgattttccggggtatgccataggcggattatctgtcggcgagccgaagcacgtcatgaaccgagtgcttgagtttacaaccccgcttttaccgaaggacaagccgagatatttaatgggtgtgggttcaccggatgccttaattgacggcgccatccgcggcgtggatatgtttgactgcgtactgccgacccggattgcccgaaacggcacggtgtttacgaatgaagggcgtctgaatatgaaaaacgccaaatatgagcgtgatttccgtccgattgacgaagagtgcagctgccatacatgccaaaattactcccgcgcttacatcagacatttgatccgctgtaatgaaacgtttggaattcgattaacaacttaccataaccttcattttctgttacacttaatggagcaggtcagacaagccatccgggaggatcgtcttggtgatttccgagaagagttctttgagcgttacggctataataagccaaatgcgaaaagcttctaaataaaaccattcatgaaaggagggaaacagatgggtactttaggcacaatcgttcctattattttaatgtttgcagtgctttatttcctgctcatccgtccgcagcaaaagcagcagaaggccgtccgccagatgcaggaagagctgaaaaaaggggattcagtggtgacaatcggaggattgcacggcactgttgattcaattgatgaaagcaaggtcgtcattaaaacaggtgataacacccgtttaacatttgaccgccgcgcaatcagagaagcttccgctgaataacagcgaagctcatacatacaaaaaaagagcggagaatccgctctttttttattacgctgatctgcttcctttcaaattcactccgaaaatgccgcccagcatactgactcccaaaaagccgagatgaaacaaaagctgaccggatgtaaacgtttttccgaaccctaaatattgaaaaagcaagatgattaatgaaaaacagacggcggttaacgctccgatcatccagcctttttccttcgctttgccgcccgatataaaacctcccgcaaataaagaaagaaaagaaagcgcggtgatcagccagctgaaagatgattcttccattgaggtgactgtcagtaaaagcgaaatcgccaaactcgtaagaagcatcaccgcaaaaatagccactaagccgtacaaaacgcctcttcccacttgtttcgtttcttccatttttatctcctctccgctctgcggcctgatatatgacaagccggagcccgtctttttctaaatgtattctctgaatgttcgaattagacgtaaatgcatgatgttcagcccgtttcttacataattcagagccgatggcaaatgctatgaccgttggaggtgcgatatggaagatattttcattattacgtttcgtacgattgtgctttattttatcattcttgtgattttcagactgatgggaaaacgggaaatcggagaactgagcattttagaccttgtcgtctccattatgattgccgagattgccgtattggcaattgaaaatgtaaaagataagcttttgcatacaattgtgccgattgtcgttttaatgattattcaagtaagccttgcttttatttcgctcaaaagccaaaaaatacggcagctgcttgacggaaaacccaccattattataaaacagggaaaaattgatgaacgggcgatgagatcgcagcgctacaattttgacgatcttcttatgcagctgagggagaataacatcgatagaatctctgacgtatcgtatgccattttggagtcttcgggcaaactgtcaatcgtcaaaaagaaaaacaataaggataagcagatggaaacatcgcttatcgttgacggggtcattcagaacgagcatctggacagaatcgggaaagataaacactggcttgaaaaaaatttagcaaaaagaggatatcgcgatctttcggttatatcattctgcacgtttacggacggcgctttttttattgatctcaaagatgaaaaaggggagccataaatcggcttcaccgcgtcacgaacttgccgatgaccggaatccggatcagctcttcccttttaatcagcctgaataacagcagcagcgcaatgtacaaaatcgcggtcattgcaatccagcctgtgagattaacagcctctgatcctgaaaaatgaacggtgtgcttgatgatgcggctgacataaccgcaaatgaatatgacggcaaaacagagcgcgtattcttttattttaatgctgatcggaagcaccttgcttacggtggccgcatgcagcagggtgacaaggaccatccccgttacaatcgcaagtgcggcgcccatgatgcctaaggaaggcctggtcgccaaaacaaaaattaggccggttttgacagcggcgccgataaaactgttcatcatggcggccccggctaaattgagagcctgcagcaccgcctgaagaggcccctgaaaatagtaaagcagaaaaaacggcgccatcactttaacaaataccgccgcattagttgatccgtacatgacggacatcagttcatcagcgaaagagaataaaataaccaccgaaatgcctccgcttaaaagacacagcctcatcgcctgttccagacggtattctacaacttgcagctttttttgctccattccttcactgatcgcaggaacaagcgccgttgacagagaataggttataaagctgggcagcgtcaaaaccgtcatggcaaatccggtcagctccccgtactggctggtggcggcagcggtggccactcctgcaatcgcaaggctctgcgcgacgacaataggttcaaaaaaccaagataaatttccgatgaagcggcttccggttgtcgggagcgacacgctcatcagctggcggaaggtttcttttccatttgcaatcgacttgaaaaattgttttctgattctgattgttttatttgctttaaaacaaatgaataaataaataagagaggcaagctccccgatgacagacgaaatcatggctcctgctgcggcatattcaatcccgtacggcagaaacaccgtcgtgcagactgcgacaagtgaaatccgcacgatctgctcaagcacttgggaaaacgccagcgggttcatattctgcctgccctgaaagtaaccgcgcagcacgctggatatcgcgataatcggcacgacgggcgtaatcgccagaagcgggaaaaccgtgcgctgatccgtcagcatcgtttctgacataatcggcgcaaagcataaaaacagcggcgtgaagatgagacttaatatcccggtgacggtaagcgccatcactaaaatgtgtttcattttctgccggtccccccgcgcgcttgcttcagcgacaagtttgctgatggcaacggggaggccgaattgagtcaaagtggtggccaagaaaaatgtcggggcagccatcatgtataaaccgaccccttcttcaccgataaaccgggcgataaccacccggttgacaaagccgagcattctcgtaatcatcccggctgcaatgagaataagagtgccccttaaaaaagtctgttttgccattttataaacccctgccttctcaaactacctggaatcatatacaataaagatatgcgccgatgtcgtccgagcatgacaagtcttcgagaaaaatggaaaaaggagcgagcgcccagtggagaaacatcccgccgaaatgtacaaagatcatttgcggcctttcttgtacagtaaacttgaagagttcaaaatccttggatacgatgatgttgagcacgagagtttatggtcatacttaatacataaaaagtggaaacagaaaaaggaattgccgctgcatgaattggccggtaatattttatcagttaaaattggcgattttatgaactatgcaaccgttgaagcttttaagtcgtctaattggctggaaagcgatgagggtcaggaagctttggatgaactgctgagataatgatttgacggcataggtttaaggaggaaatacataatgaaaaaaggacgcttgattgcgtttttcctgatcgtattattgatcggcacagggctggggtattttacaaaaccggctgccaataatattacgttaggattggatttacgcggcgggtttgaagttctgtacgatgtgcagcccgtcaaaaaaggcgataaaatcacaaaagacgtgctcgtcagcacggtgcaggcgctgaaccgccgggctaacgttctcggcgtaagcgagccgaacattcagattgaaggaaataaccgcatacgcgttcagctggcgggcgtcacgaatcagaacagggcgcgcgaaattctgtcaacggaagcgcagctctcgttcagggatacgaatgataaagagctgttaaacggctctgatctcgtggaaaacggcgcgaagcaaacctttgatccgacgacgaacgaaccgattgtcagcgttaagctgaaggatgcggataagttcggagaagtgacgaaaaaagtcaagaaaatggcccctaataatcagcttgtgatctggcttgattaccaaaagggcgattcatttaaaaaagaagtcggcaaaaaacatccgaaatatgtatccgctccgaatgtgagccaggaattaaacacgaaggatgtcacgattgaaggtcagttcaccgttcaaaaagcgaaggacttggccaatattttaaacgcgggtgcgctgcctgtgaaactgaccgaaaaatactctacttcagtaggggcgcaattcggacagcaggctttgcatgatacggtagaggccggcatcatcggtattgcaattgttttcttatttatgctgctttattacagactgcctggactcatagcggtcattacgctttctgtatacgtgtatattacgcttcaagtgtttgactggatgcaggcggtgctgacgcttccgggtattgcggcgctcattttgggtgtcgggatggcggttgacgccaacatcatcacctatgaacggataaaagaagaactgaaactcggcaaatccgtccgctcagctttccgttcagggaacagacggtcatttgcgacgatctttgatgcgaacatcacaacgatcatcgcagcggtcgtgctctttattttcgggacaagctctgtaaaagggtttgcgacgatgctgattttgtcaatactgacaagctttattacagctgtcttcctttcaagattcctgctcgcccttcttgtggaaagcagatggcttgaccggaaaaaaagctggttcggcgtcaagaaaaaacatattatggacattcaaaaaacagatgaaaatactgaaccgcatacggcattccagaaatgggatttcacgagcaaacgaaaatatttctttattttctcaagcgctgtaaccattgcgggaattatcatcttactggtctttaaactcaacctgggaatcgattttgcaagcggtgcgcggattgacgtgcagagcaatcatgcattgacggcgcagcaggttgaaaaagactttgactctctcggcatggatccggaaaacatcgtactctcgggtaaagagaaccatgttgccgcggcccggtttgtcggagagccatccaaagaaaaaatcgctgaaatcaaaacgtactttaaggacaaatacggatctgaaccgaacgtcagcacggtatcgccgacagtcggaaaagaactggcccgtaatgctttatatgccgtggcaattgcatcaatcggcatcattatttacgtgtcaatccgtttcgagtacagaatggcaatcgccgcgattgtatccctgctgtatgacgctttctttatcgtcgcgtttttcagcattacaaggctggaggttgacgtaacctttatcgccgctattctcaccataatcggttactcgataaatgatacgatcgttacatttgaccggatacgcgagcagatgaaaaaacgcaagccgaagtcatttgccgatctggaacatatcgtgaatctgagtttgcagcaaacctttacacgttcgatcaatacggtcttgaccgttgtgattgtggtcgtcgtgctgctcattttgggctcatcgtcaattacaaacttctccgtcgctttattggtcggtttattgacgggcgtttattcctctctttacatcgccgcgcagctgtggcttgtatggaaaggaaaagaatttaaagggaaaaaatcaatcgaagagtaaaaggaaacaggctgtcttccggaaggcagcctgttttttttaggccgcattgaacttaaaacctgcatttgctataatgacatacgcttacataatcaatcatcattgttaaaacatgtagggggttcttatgaacgttcgtgagtcggagcttccgggcatcggccagaaagtagaagtcattacgaaaaatcacgataaaatcagtattattcttcatgatgacggcagaaaagagctctattacttcgatgagaatgattatgacgaatgcttggcatccgttgaatttaacgacgaagaggcgaggcagatttccgctattttaggcgggatgacgtataagccgaaagcgctggaatctgtggaagtcgcgcttgatgacctcgtcattgagtggtttaaagccgaatctcatgcaccggctgtcagccgcacaatcggagatttggagatcaagaaacattacaacgtccagattattgcgatcgtgaagaaaaaccggcaaaaacagctgagccccggcattgataccgtaattgaagaaggggacaccctcgttatatcgggagaaagaagcggactgaaaaagctggtccgcgagcaattaacggcccggatttcctgagaccggggtttactcccgggaaaatgggggaaaagataagaatcaataattgggggcagacgcatgaataaacaatggactattatattcgctttactatttactctgattgtcgccatctttgctgtcattaacgtgcgggcggttgaggttgattatctgttcggaaccgctgaatggccgctgattttagtcattttaggctctgtgttaatgggagcgctgatcgtgttttcagccggtatatttcaagtgatgaaactgaagcgcgaaattaaaatgctgcggaaagaaaacagatccgcaggtgaattgacggctgattcggacggcaaaaaaacagccgcgccgccggaagaaatgcttgaagagaaaaaaggatcagaataacatttgaaacccctcagtccgctctagtataatagggtggttgaggggtgaatttatgttagcgtcaaaaatgcgctgggaaatccagcagccggatcaggaaaaagtcaaatcactcacagaacaattggacataacacctcttgtggcatcactgcttgtaaaaagaggttttgatactgccgaaagcgcaaggctgtttttacatacaaaggatgcagacttttatgacccgtatgaattaaagggaatgcgggaagcagttgatcggataaaactggcggtttctcaaggggaaccgattatgatttacggagattacgatgcagacggcgttacaagcacgtcagtgatgctgacggcactcagacagctgtcggcggacgttgacttttatattcccgaccgttttacagaaggctacggcccgaatgaacaagctttccgttccataaaagagcggggattttcgctgatcattacagtggatacgggaatcgccgccgtccatgaagctgaagtcgcaaaagagctgggcttagacgtcattattaccgaccaccatgagccgggacccgagcttcctgacgtatttgcgatcatccacccgaagcagccgggatgcggctatccgtttaaagaattggccggcgtcggtgtggcgtttaagcttgcccacgcgcttacgggttctttgccggaagctatgctggacttggcggcaatcggtacggttgcagatctggtgcctcttcatgatgaaaacagattaattgcgtcactcggaattgaaaggcttcgtacgacaaatcggccgggcctcaaagctctgattaagctttccggcggagatatcggacaagctgatgaggaaacgatcggatttcaggtcgcaccgaggcttaatgccgtcggaagaatagaacaggccgatcccgctgtgcacctgctgatgaccgaagatcagtttgaagcggaggaactggcttcggatattgaccggctgaataaagagcggcagaaaatggtgaaaaccatgaccgaagaggctgttgaaatggtacagcagcaaggcggaaacccgtctgccattgtagtggcaaaagccggctggaatccgggtgtcgtcggtattgtcgcatcgaagctggctgaacgtttttaccggcccgctgttgtgcttgggatagatgaggagcagggaatcgccaaagggtcggcgcgaagcatcagaggcttcaacctttttacgagcctttcacagtgcagagacattcttcctcatttcggcgggcatccgatggcggccggaatgacgctgaaggctgaagatgtggcggaattaagggacaggctgaatcaaatggctgaagaaacccttacggaagaggattttattcccgttcaggaggttgatcttgtctgcggcgttgaagacataaccgttgaaagcattacagaattgaatatgctgtcgccgttcggcatgcttaaccctaaaccgcatgtgatggtgaaaaatgccgtgcttgatgatgtgcgcctgatcggagcgaataaaaaccacgtgaaaatgacggtgaaaagtgattccgccgtccttgactgcgtcggctttaacaaaggagagctggaagccggagttgttcccggatcaacgatttccattgtcggcgagatgtccattaatgaatggaacaacagaaagaagccccagctgatgattaaagatgctgcggtgccggaatggcagctttttgatattcgaggcaagcggacgtgggaagatacggtcaccgcactgccgaaggaaaaacgggtgctcatcagctttaacgaaaaaaccgctcagaagctccgtgaaaaagagctgacgggcgagcttgccgagatcacttcggaatccgaggcggaagctctccagcttgacggaaaatatgccgtttttctggatgtgccgccgtcagcggatcgcctgcagcatttgcttgacggaaagaagccggaacggatttattttgtttttatcaatcatgaagaacatttcctgtcctcatttccatcgcggaatgatttcaagtggttttacgcatttctcttgaaaaggggcgcttttgacttcggcaagcatggttcagagcttgcgagacacagaggatggtcaattgacacaatcaatttcatgacaaaggtgttttttgatctcggttttgttaaaatagaagatggtgtgctgtctgtcgtgagcggtgcgaaaaaacgcgacctggcagattcgcaaacctatcaggtaaaacagcagctgatggaattagaccagaagctcaattattccgcagcccatgagctgaaggaatggctgaataagctgatgaaccaaggttcagaggcttatgaaagtacgaggaggacatagaacagatggatcttaaaaaatacgtaacaattgtgcccgattacccgaaagaaggcgtacaatttaaagatattacgacattgatggacaaaggcgacgtataccgttacgccactgaccaaattgttgaatatgcaaaagaaaaagaaattgatttagttgtcgggcctgaagcgcgcggctttattatcggctgtccggttgcatacgcactcggagtcggctttgcgccggttcggaaagaaggaaaacttccgcgtgaggtcattaaagtcgattacggtttggagtacggaaaagacgtactgacgattcataaagatgcgatcctgccgggacagcgtgtgctgattactgatgacttgcttgcaacaggcggcacgatcgaagcaacgattaagctagtcgaagaactgggcggcgtcgtagccggtattgcgttcttaatcgagctttcttaccttgacggcagagacaagcttgacgattatgatattttaacattaatgaaatattaaccgcatatggaaaaaagcactcgtgtcagggtgcttttttcctattatttcatcatcctgacagattctttaggtgttttgaacttctgccctttacatctctcgtttttttcttgataataaactaatacagtttacatttaaaaaaggtgattccatggcgaacgaacaagtattgactgccgagcaagtaatagataaagcgcgcacttatctgccggaggagcagattgcgtttgttgagaaagcttacctgtatgcgcaaaacgcgcatcgcgaacagtaccgcaaatcaggtgagccgtacatcattcatccgattcaggtggcggggatcctcgtcgatttggaaatggacccttccacaattgcgggcggatttctgcatgatgtggtggaggacacggatgtcaccctcgacgacctgaaggaagtattttctgaagaagtggcgatgcttgtcgacggcgtgacgaagctcggtaaaattaagtataaatctcaagaggagcagcaggcggaaaaccatcgaaaaatgtttgtcgctatggctcaggatatcagagtcatattgatcaagctggcggatcgccttcacaatatgcggacgttaaagcatcttccgcaggaaaagcagcggagaatttcaaatgagacgttggagattttcgctccgctggcccatcggctcgggatttctaagatcaaatgggagctggaagacaccgctctccgttatttgaatcctcagcaatattacagaatcgtcaacctcatgaagaaaaagcgcgcggaacgcgaactttatgtcgaagaggttgtcaatgaagtgaaaaaacgcgttgaagaagtgaatattaaagcggacttttcaggacgtccgaagcacatctacagcatttaccgcaagatggcgctgcaaaataaacagttcaatgaaatatatgatctgctcgccgtccgtattcttgtcggaagcattaaagactgctacgccgtactcggcattattcatacgtgctggaagccgatgcctggcagattcaaagattatattgcgatgcctaagccgaatatgtatcagtctctgcatacgaccgtaatcgggcctaaaggcgatccgctggaagtgcagatcagaacgtttgagatgcatgagatcgctgaatacggggtggccgcacactgggcttataaagaaggcaaggctgcaaacgaagaagcgacatttgagaaaaaactgtcctggttccgtgaaattctggaattccaaaacgagtctacggatgcggaagaatttatggaatcgctgaaaatcgatctgttttctgacatggtatacgtatttacgccaaaaggcgatgtcattgaactgccgtcaggctctgtgccgattgatttttcctacaggatccactcagagatcggcaacaaaacaatcggggcgaaagtgaacggaaaaatggtgacgcttgaccataagctccggacgggcgacatcgtcgagattctgacgtccaagcattcttacggtccgagccaagactgggtcaaactggcgcagacgtcccaggcgaaacacaaaatacgccaattctttaagaaacagcgccgtgaagaaaatgtcgaaaaaggccgtgagcttgtcgagaaagaaattaaaaatcttgattttgaagtgaaagatgttttaacgctcgaaaatcttcaaaaagttgccgacaagttcaatttctcaaatgaagaggatatgtacgcggcggtcggatataacggcattaccgctcttcaggtggccaacaggctcaccgaaaaagaacggaagctgcgtgaccaggaagagcaggaaaaaatcgttcaggaagtcacttccgagccgaaacattatcctcaagggagaaaacgggaagcgggtgtgcgcgtaaaaggcattgacaaccttctcgtccgcttgtcgaaatgctgcaacccggtgccgggcgaccatatcgtcggttttattacaaaagggcgcggtgtatccgttcaccgggacgactgtccgaacgtcaaaacgaatgaagcgcaggaacgtctgattcccgttgaatgggagcatgaatcacaggttcaaagacgcaaagaatataacgttgagattgagattttggggtatgaccgtctcgggcttttaaatgaggtgctccaagccgtaaatgaaacgaaaaccaacatctcctctgtctccggcaaatccgaccgcaataaagtcgctacgattcatatggcgatttttattcaaaacattaaccatctgcacaaagtggtcgagcggattaagcagatcagagacatctattcagtccggcgggtaatgaactaaaaggagcttgctatgaaattagttgttcagcgtgtaacagaagcgagtgtgacggttgacggcgctgtcgccggccggatcggacccggtattatggcgcttgtcggcatcactcatgaagatacagaagaagatgccgcttacttggcggataaaatcgtgaatcttcggatatttgatgatgaaagcggcaagatgaatttatcgcttttggatacgggcggggagattttatccgtttcccagtttacgctttacggcgaaacaaagaaagggagacgcccgaattttatgaatgcggctaaaccggatcaggctgtgctcctttatgaaaagtggaacgaactccttcgggaaaaaggagtcaaagtggaaaccggaatattcggagccatgatggatgttcagctgacgaattccgggccgattacattgattatggattctaaacaataaaaaagctgccgttcggcagctttttttttatgattgaaaataatgttccaatccgctttcaattccgtctgtcactttttcctgataagagccgctatgtatgattgtttcttcttgcggttgactgagatagccgagctcatacagcatggcaggccgtttattttccctcaggacgtaataatcgccaaacagaacgccgcgatcaggaataggggaacgcttcactacttcagaatggacgtctgaggcaagctggcggtccttagacggactgtaataataagccgtgcttccccgcgttgacgtatcggcataactgtcatagtgaatgctgataaaggcatccgcattccggtaatgagaggttgaaaccctggcctgcaggctgataaatgtatcatcctgtctggtgatatacacgtttgcaccggccgctctcaattttccggctaacagcttagctgttttaatcgttacgtttttttcaaactttccggagtagccgatcgttccgctgtcttttcctccgtgtccgggatcaacgacgatcgttttgtttttaagtgagccgctgccgcctgacgtgttgggagaaggtgcttcgcctgtttcctcaccgctttttgacgtttgtacgacccagtctgccacatatgcggtttgtccgttttcaagccggacttcataccatttgccgcttgagccgacaatcgggtaggctgcgcctttatctgccctttttacgatagaagcggaagtcgaggccgagctccttaagttggtgccgccgtaaacaatatacgcttttttcgaggagcctgagcccgcagaaccgtctcccgagccggatgcgctgcccgatgagtcagaatcctttatgatgtagtggcttgctgcccagcctttttgcccgtttgcttcaattttcagccagccgtggtcttcacttaagatggaaacctttgttccgcgtgataatttagtcataatcgctgaatcatgtgacgctgcacttctgacattcaatgaagaaacgccgaccgtcccgctttttgacccgcttcgggccgaagttgctttcgtatccgatccgccgctgtccgcggtgacgtattcggaagaaacccacccggttgtgccttgataagaaatgttcacccatccgctgttcttgtccagcacggatgcatgcgcgccttgcggaagtttgccgatgacttcatacgatgtccccgggccttttctgatgcggaggtcaggatcggtggaagtgaccgttccgctttttgcggatgaattgtctgctcccccggctgtttttgatatcagccaggaaacgacccatccggttttaccggggctcagctgaagctgtacccagtctccctcttctttaacgatcgggtatctttcccctttttttacttcagcctttattccgtagctcaggccgggaccgcctctgacattgatcttgtctgtcgcgatgaccgcttctccctctgcggcgattgcggtgtgaaatgacggaagaagcgctgtgatgatgacgccgcataaaataagagcaagagttctcttcttcatggctgtcctcctttctgaactaactaaaatacattcttgtataatatcgtattttccttgctgaatgttaaataaaaataaaatggtttgtttatactagtcataaatacagcgaaaaggtgtgcaaatcatgaaatatcaaccaaaaatgggacgcgcgctgcacgatgcggaaggaaatctgcacttcagtgatcagagcgatagagaaaaggcgggttttcttgaagagacggcgacggagttcggtctcttatcgaaagaagcggtcgcaaggaaaaacagacggaataaaacttgacaggggagtgcaatcccattattataatagaaattgatgtacataactcatgataacgattttgaaccgataatggagaagagtaggtcagaatgcatggaaaagagaggaaccgtcccgggctgaaagcggatccgcactgcatctttctcgaaacaacactccggaggttccctgctgaacgcttttgcaagtcattaggcagcggacgtgaacctgcgttaaaggtcagagcggggatgcttcggcattccaactagggtggcaccacgggtataactctcgtccctactatacatgtatagtaggagcgggagtttttttatttgaagaaagacattaaggaggcctgtaacatggcatatcacattccaagaggcacacaggacatactgccgggtgaatcagacagatggcagttcgtcgaacaaattatgagggagacgtgccgcacttatcaatataaagaaatccgcacgccgatcttcgaacatacggaattattcgcaagaggcgtcggtgagtctacagatatcgtgcagaaagaaatgtacacgtttgaagaccgcaaagggagaagcttgacgcttcggccggaaggaacagccgccgcagtccgcgcgttcaatgaaaataaattatttgcgaacccggtgcagccgacgaagctttattatgtcggaccgatgttccgttacgaacgtccgcagacagggcgtttccgccaattttatcaattcggaattgaagcgatcggctccaaagatccggccgtggatgcagaagtcattgcgcttgcgatgagtatttaccgtaaagccggtttgaaacatgtcaagcttgtgctgaacagccttggtgaccaggagagccgcaaatcctaccgggaagcgctcgtcaaacattttgaaccgcgcatcggagaattttgctcagactgccagtcgcgtctgcacacaaacccgctcagaattcttgactgcaagaaagacagagagcatgaactgatgaaaacggctccgtccattcttgattacttaaatgaagaatcagccgcttattttgagaaagtaaaacaatacttaaacggtctcggcatcccgttcgaaatagatccgaaccttgtcagagggcttgattattataaccataccgcttttgaaattatgagcaatgccgaaggattcggagcgattacaacccttgccggcgggggccgctatgacgggcttgttgaacagatcggcggacctgaagcgccgggtatcggatttgcgatgagcatcgaacgactgctggcagccattgacgctgagaaaacagaccttcccgtcaatcaggggatcgactgctacatcgtgacgctcggagaaaaagcgaaggattattccgtttccctcgtgtacaaactgagagaagcgggcatctcaagtgaaatcgattatgaaaataaaaagatgaagggccaattcaaaacggctgaccgtctcggcgcacgttttattgcgattttaggggaagatgagcttgcccaaaataaaatcaatgtaaaagatgcggaaacaggagagcagcgtgaagtggtgttagacgagctgatacaagtgttaaaggcagatcaaaagcagtgaaggagaggaacgctatgtttggaagaacatattattgtggcgagataactgaaaaagcgattggcgaaaccgtcaaactgaaagggtgggtgcagaagcggcgcgatctcggcggcttgattttcattgatttgcgtgaccgctcgggtattgtgcaagtcgtgttcaaccctgacgtatcgaaggaagcccttgccgcagcggaagcaatcagaaacgaatatgtgcttgatatcgaaggcacggtttctgcccgtgaagaaggcacggtgaatcccaacctgaaaaccggtaaaattgaaatcaaagctgaagcggtgacggtgctcagtacggcgaaaacgcctccgtttccgatcagtgaccaggcggctgacgtttctgaagacgtccggttaaaacaccgctatttggatttgcgccgcccggcgatgtttcaaacattgcaaatgcggcatcaagtcacaaaatccatccgccatttcttggatgaaaacggatttcttgatattgaaacaccgattttaacaaaaagttctcccgaaggcgcccgtgattacttagtgccgagccgggtgcatgaaggggaattttacgcccttccgcaatcgccgcagatttttaaacagcttctgatggtgtcgggctttgaacggtattatcaagtggcccgctgcttccgcgatgaagacttgcgtgccgaccgccagccggaatttacgcagattgatattgaaatgtcctttatgagtcaagaggacatcatggctctggcggaagagatgatggcgaaagtcatgctcgaaacaaaaggcgttgaagtatcgcttccgcttccgcgaatgacatatgaagaagcgatgaacagctacggttccgacaaacccgatacccgcttcggcatgctgctgacggacgtgtcagacatagtgagagatactgaatttaaggtgttctcatcagccgtggcaaacggcggcgttgtaaaagcgatcaatgtcaaaggcgctgccggcgactattccagaaaagatatcgatgcgctcggcgtttttgccggaaattacggcgcgaaaggtctcgcttgggtgaaagtagaagctgacggcgtaaaaggcccgattgcgaaattctttgatgaagagaagcaggcaaaactggctgaagcgcttgatgcttctgaaggcgatctgctcctgttcggcgctgataagtttgaggttgtggctcaatccctcggcgcgcttcgcttaaagctcggcaaagaacgcggcctgattgacgaaagcctcttcaacttcctgtgggttgtggactggccgttattggagcatgacgaggaagaaggccgtttctatgcggctcaccatccgtttacaatgcctgtccgtgaagatcttgacctgattgaaacggcgcctgaagatatgaaagcgcaggcttacgacctcgtcttaaacggctatgaactcggcggaggctcaatccgtatttttgaaaaagacgttcaggaaaaaatgttcgggcttctcggctttacaaaagaagaagcggaggaggagttcggataccttcttgaagcctttgaatacggcgctcctccgcatggcggaatcgcgctcggcttagaccggttggttatgcttcttgcaggccgcactaacttaagagatacgatcgctttcccgaaaacggcaagcgcaagctgccttcttacggaagcgcccggcgaagtgagcgacgcccagcttgaagaacttcacctttctgtcaaaagaaaagtgaaacagtaaagatcggcagtttgtttcttgaaaatcaaaatctgctgtgatatgattttgacaagttaaataaagtcctgatgtgttagttgtacacctagttttgaccgaacatttttttgatttgggagcccgcatttttaaatggcgtacatgcctcttttcattcgctaaagaggacttacaagatttaaaaaagggcacccacctgctgagagcgggttcaaaacgaaggaaagctgcaacggcacaattgggactttattttttgtgcgctaaaaccagcggctttttgacaagccgagtttataaaaccagaatgtggagtgaggttcttgttacatcagttttccagaaatgagctagcgattggaaaagaagggctggacacgttaaaaaacagcacggtggccgttctcggcgtcggcggagtcggttcattcgcagccgaagcattggcgaggtccggagtggggcggatcgtgcttgtcgataaagatgatgttgacattacaaacgtaaaccgccagctgcatgcgctattgtcgacggtgggacagccgaaaacagaattgatgaaagagcggatcgctgatattaatccggattgtgacgtcgtcgccttaaaaatgttttatacagaagagacgtatgagcagttctttgagtatccgctcgattacgtcattgacgcgtcggatacgattcattataaaattcatctgatgaaagaatgtctgaaacggaatgttccgctgatttcaagcatgggagcagcgaataaaacagacccgacacgctttcagattgctgatatttcaaaaacccatactgatccgattgccaaagtcgtccgcacaaggcttcgtaaagagggcattaaaaaaggcgtacaggtcattttttctgatgaaagcccgatcgtcatccgtgaagacgtcagaaaagaagtcgggaatgatgaagcgaaaatccgcaaagcgcaaatgccgccgtcttccaacgcctgggttccgtcagtggccggtctgattatgggcggacatgttgtcatggagctcttaaaggacatcgacattaaacgggttaaagataagtaaaaagaaaaacagccttcttcaggaaaggctgtttttttatttgaatccgccgtttacacgaaagatcttgtccggttattttttctgcttcatcagtttttcatacacttgctttatggcggcttcaaatttccccgtttgtttcggtttatagtattgcttgttttttaacggatcgggcaaatattgctgttcgacccatccgttctcgaaatcgtggggatattgatagccgatcccgcgtccgagctcttgggcccctttatagtgggcgtcttttaaatgtttcggcacatcgccgattttacccgtcctgatgtctttgagcgcctcatcaacggctgaaatggcggagtttgatttcggtgagaggcataattcgattaccgcattggccagcggaattctcgcttccggaaagccgatccgttctgcggtctgaatcgcgctcagcacccggggcctgcctgcgggcttgcgaggccgatatcttcataggcgatcacgagaagccttcttgatatgctttcaaggtctccggcttcgatcagacgggccagataatgaagggcggcgtttgcgtccgagccccggatcgatttttggaacgcggataagacgtcataatgcgcatcgccgtttttatcatgggtatagctttttttctgcagacattcttccgccgtttcccgtgtaatccggatcgtcccgtcgcttgattcctttgtggagagcacggcaagctccagtgcgttcaaagcggagcggacgtctcctccgcacccttgtgcgaaatgatccatcgcgtcgtcgtccaccgaaacgctgtaggaaccgagtccccggtgttcatctgtgagcgctcttttcaatgcctgcctgatcagatcgggtgttaacggttcaagctcaaatatctgggtccggcttctgatggccgggttaatggcatgataagggttggcggtcgtcgcgccgattaaaataatcatgccgttttctaaatagggcagcagaaaatcctgctttcccttatcaagtctgtgcacttcatcaaggattaaaatgacctggcctgacattttcgcttcctgtacgacaatctccatgtcttttttattatgaatgacggcattcaatttcctgaatgcgatgcttgtcgatcctgcgatcgctgtggcgatggacgtttttccgatgcccggcggtccgtacaggatcatggatgataagtgcttcgcacgcaccattctgccgatgattttatcttctttgaccaaatgttcctgaccgataatgtcttcgatattggcaggccgcatccgatacgccaatggtttcatgaacatctctccttacatatacagggtaacggaaaacggacgattagaaaagcgaattgcggcgggccccgtgtttcaatgaaaattaggataagttatgttataataacagttggtctataagatactaaacagattattcatatccatttacttgtataaattaacaattagaattgactggggtgttcatattgaaaatatcgacaaagggaagatacgggctcaccattatgattgaattggcgaaaaagcacggagacggtccgacgtcgctcaaaagcatcgcccaaacaaacagcctttctgagcattacttggaacagcttgtatcaccgctcagaaacgccggactcgtaaaaagcatcagaggcgcttacgggggttacgtgctcgggggccagcctgaagagataacggccggagatattatcagagtgctggaagggccgatcagcccggtagaagtgcttgaggatgaagagcctgccaagcgggagttatggatccgcatccgcgacgctgtaaaagacgtgctggacagcacgacgttagaagaccttgcgagctacacggacggcgagcaggaagcttatatgttctatatttaaaccagaggtgtaaagacaatggaacggatttatttagatcatgctgcgacttcccccatggatgaacgtgtgctcgaagaaatgaagccccatttcttcggcagtttcggcaacccgtcaagcattcattcattcgggagagaatcccggaaatgggtcgatgaagcgagagcggacatcgcgcgcgaaatcagtgcgaaagaacaggaaattattttcacaagcggcggtacggaggctgataatttagccattttcggaacggctgccgcccggaagaatgaaggaaagcatatcattacgaccgctgttgagcatcatgctgtattgcacgcctgcgaaaagctggaagaagacggctttgaggtgacatacctcatgcccggcccttcaggacggatcagtgcaaatcaggtgaaagaagcgctccgtgatgatacaatccttgttaccgtcatgtatggcaataacgaagtcggaaccattcagccgattgacgaaatcggagagctgttaagcgggcatcaggcctattttcacacagatgccgtccaggcattcggttatatgccgattgatgtgaaaaaaagcagaattgacatgctgtctgtttccggtcacaagcttaacgggcctaaagggacaggctttttatatgtaaatcaagaggtgaagctgtcaccgattcttcttgggggagagcaggaacgaaagcgccgcgcggggacggaaaatgtaccgggcatcgccggcttaaaagaagcggtcgtcctttcaaaccgtgagagggaagagaaaacagcgaagtataaggagtttaagaacatcatcatgagcacgctggaagaagccggcgttacagcggaggtgaacggagatgccgagaaatgcctgcctcatattttaaacctttactttcccggtgtgccggtggaagcgctgctggtcaatcttgacatggaaggcattgccgtctccagcggatctgcttgtacggcgggatccgttcttccgtcccatgtgcttacggccatgttcggaagtgagagcggcaggctgacttcgtcaatccgcctcagcttcggcctcggcaatacggcggaacaaatcgaaacagccgccgaaaagcttgccgccgtcgttaaacggcttgcttaaaacggcggacttatgtttttaatggagtgaatgcaaatggaaaaacggccggaggatacaagagtcgtagtcggcatgtccggcggcgtggactcttccgtggcggcccttctgctgaaggagcagggctacgatgtaatcggaatctttatgaaaaactgggatgatacggacgaaaacggtttttgcacggcgacggaagattatgaagacgtcatccgggtctgcaaccagatcggaattccgtattatgccgtcaattttgagaagcaatattgggaaaaggtatttcaatatttccttgatgaatataaagccggaagaacccccaatccggatgtcatgtgcaataaagaaattaagtttaaggctttcttggatcatgctctgtcactcggcgcggattatcttgcgacgggccattacgcccgcgtggacagaagcgcagatacagtgcgcatgctccgcggtctggatgaaaacaaggaccagacttattttctgaatcagctcaatcaggaacagctcagtaaagtcatgttcccgatcggtgatctgcaaaaaagccgcgtgcgggaaattgccaaagaagcagaacttgcgacagctgcgaaaaaagacagcacgggaatctgctttatcggcgaacgcaacttcaaaacgtttctcagccaatatctccccgctcagccgggcgatatgatgacaatggacggagaaataaaagggcgtcatgacggtctgatgtattatacaatcggacagcgccacggtcttggaatcggcggaagcggcgagccgtggttcgccgtcggtaaagatcttgaaaaaaacattctgtatgttgatcaaggattccataatccgcttctgtattccgataagatcacggcgacaaatgtcagctggacgcgtcccggtctgatggacggcggcgaaatgacatgcacggcgaaattccgctaccgtcaggaagatcacaaagtaacggtgaaaatgacgggtgatgatgaagcggaaatcatttttgacgggcaggtacgcgccgttacgccgggacaagccgtcgttttttatgacggagaagagtgcctcggcggcggaacgatagatgacgtttataaagacggaacaaaactgtggtacgtataacacatgtaaaaaacctcaactcgcatgttggggttttttagcgaaaggaagttaaaaatggattataataaaatcgggattgacgccatgcaggagggcgattttgaaaaagcggcagaggcttttacgaaagcgattgaggaaaacggccaagacccggtgccgtacatcaacttcgcaaatctgctttcttctgtgaacgaactcgaacgggcgcttgcattctataacagagcgcttgaattggacaattcggcggcagccgcttattacggtgcgggaaacgtatatgtgatgaaagaatcgttttccgaagcgaaggatatgtttgaaaaagcgcttcgctccggaatggaaaacggagatttgttttatatgctggggaccgttctcgttaaattagagcggccgaagcttgcactgccgtatctgcagcgtgccgttgaattaaacgaaaatgacacggaagcgcgcttccagttcggaatgtgtcttgcaaatgaagaaatgctggatgaagctcttgcgcagtttgagacggtgatcgagcaggatccaggccacgcggacgcattttataatgccggggtcgcttacgcgtacaaagaaaatcgtgaaaaggcgcttgagatgctggaaggcgcaatcggcatacagcctgatcatatgcttgcgcttcatgcgaaacagcttatcacccagtcataacaaaaggagggaaggctcgtggatcagctgaacatcgaagaacagccgtatgtaaaaggcgtcattcatacggtcatttatcataatgacaccaacctgtatacagtgctgaaagtcaaggttgcagaaacgtctgaggcgatcgaagacaaggtcgtatccgtaacgggctacttccctctgctgcaagaagatgagacctacacattttacggaaaaactgccacgcatcctaagttcggcctgcaatttcaggctgaacactttaaaaaagaaattccgaccacaaaagaaggaatcattcactatttatcaagtgatctgtttgaaggaatcggaaaaaaaacggcggaagaaatcgtcaaaaagcttggagacggcgcgctcaataaaattctggctgatgcgtcggtgctttatgatgtgccgaaaatgtcaaaaaagaaagcggacaaactggcgggagagctgcagcggcatcaggggcttgaacagattatgatctctctgaaccaatacggtttcgggccccagctatccatgaaaatatatcaggcctacgaaacggaaaccttggagaaaattcaggaaaatccttatcagcttgtaaaagacgttgaaggcatcggctttgtgaaagctgacgagctgggcggaaaaatgggtctgtcaggaaaccacccggagcggatcaaagcggcaatcttatatacgattgaatcgacctgtctttcagagggccatacgtacatagagacaaagcagctgattatcaatacgcaaacgctcctgaatcagtcagctgaaggcggccgcgtcacggaaatggatgcggctgacggcatcatcgccctcggggagagtaaggatatcgtcatcgaaggagagcgctgctattttccctccttgttttacgcggaacaaaacgtcgcaaaacgcgtgctcgacattgcggctcagacggagtatgccgatcaatttcctgaatcggaatttctgcttgcactcggtgaactggaagaacggatgaatgttcaatacgcaccaagccaaaaggatgccattcaaaaagcgctgtcttcaccgatgcttttactgaccgggggacctggaacggggaaaacgaccgttattaaaggaatcgtggaattatacagtgaactgcacggcgtatcccttgaccccggtgattataaaaaagacgaggcgtttccggtgctgcttgccgcgccgaccggaagagccgcaaaacggatgagcgaatctacgggtctgccggctgttacgattcacaggctgctcggctggaatggcgctgaaggctttacctacaacgaagatcagccgattgaagggaaactgatcattatagacgaagcgagtatgcttgatatctggctcgccagccatttgtttaaggcgcttcctaagcacattcagctcattgttgtcggtgatgaagaccagcttccttcagtaggaccggggcaggtgctcagagatcttttggcttctgaagtgctgccgaccgtgcgcctgacagatatttaccgtcaggctgaaggatcatccattgtggaacttgcccatgatatgaaaaaaggactgcttccaaaggggctgaccgcgccgacaaaggaccgctcatttatccgctgtaattcttcacagattaaagaagtcgtggatcaggtcgtctcgaatgcgttaaaaaaggggtatacctccagagatattcaagtgcttgccccgatgtacaggggaaaagcgggaattaacgagctgaatatgcttcttcaggacatcatgaatccgcctaaagaaaaaaggcgggagctgaaattcggagatgtcgtctacaggacgggcgataaaatattgcagcttgtcaaccagccggaaaacaatgtgtttaacggcgatatcggcgaaatcgtgtccattttttatgccaaagaaaatacggaaaaagaagacatggtcgtcgtctcgtttgacggcaacgaaatcacctttacgaaaaaggatttcagccagtttacccacgcttactgctgttccattcataagtcgcaggggagcgaattcccgattgtcgtcctgcctgtcgtcaaaggctactatcgaatgctcaggagaaatctgctttataccgccattacaagagcgaaaaaatttctgattctttgcggagaagaagaagcgcttgaatggggcgtcaaaaacaatgatgccaccgtcagacagacgtcgcttaaaaacaggctcacagagcagactgaagagatggatgcagaactggccgccctgcaaaaagagctgccgttcagtgtatatgatgcgaacatcggaatggaaggcatcacgccttttgactttatggaagaaaaagcgtaaataaaacccggcacatgttcatgcgccgggttttcgcctgtggaagtcatttcaaagtatgctgcctggcttcttggcaaaacctatacgtgttcaacaaaaggtggttgatcacactttgagaacatgccatgcagctgaaggacgaacagtatatgacgaaaacaccgggcgcagtctcgggatgatatcggatgtatgtttctctctggacggccggtttctcggtttcgtgctggagcagaaacgcctgtttcacaaccgtcatctttttttaggggcaagtgatataaaagagatggatcaagaagccgtagctgccggtcatgctcatttgcagcctttgccgaagagctgtttcacctttgaacagattaaaatgcagccggtgaaatcgcctgatggtgaaatgttcggtttgctggaagatgtatacttttgtttggacaggggcataatcgtagcatatgaactctcggacggcttcttttcagatctggctggcagacgccaagtgcgccgcgccgccgatatgcttattgaagcggggaaagaaggcatcgtcctgaacggataagaggtgtagtctgtgcttgtatgtccgaactgcaaaagtaaagatatcggcaaaatcggcgtaaaccaatactattgctggggctgcttcattgagctgacggtggccaaaggcaaaattgcgacacatcaagtagaggaagacggcacgttaagcagtcttgatgatttgttttctgaagacgaacgcagtatcaatttttaaagttgaaaggagatacgcgcgatgggcagaacaatgacctctctgttggctttaggggctggagccgttatgtatcgtatggcttctcagtccgatatgctgaataaaaaaggtatgaaacggatgagaagacgagtcatgaaaatgttttaagcggaaaaaaggatacttctccggaagtatcctttttacgtttgtctcgcttccagccgtctggcagcgagagacaggctgtaattgaccgcgaaatacatcagggccgccagcagaaagatcgggaaaaaataccccccgtcagcgctttgtccgtttaaaatctgcgcgttatgaatcagttcgggcagagcgatgacgaccgcaagtgacgtatcctttaataaggagataaactggctcacaatcggaggaaccatacgcctgagcgcctgcggcatgacgacgagaaaaagagtctgcgtgtacgtcagtcctgaagaacgcgccgcttcaatctgtcctttgtcaacggattgcaaaccgcttctgatgatttctgacagcatggccgattcaaaaatcgtcagcgccgtgatggcggccgcggtaatttccagtttgatcccgatttccggaagggcaaaaaacgtaaagaaaatgattaataacagcggcaggttgcggatggtttccacaatggccgctataatgcccgagacgataggaatgttcgcatagcgcaaagtgccggcggcaagcccgaacataaaactcaggacaatggagatcagcgcaacataaagtgtgaccaaaaagccgtcccataaaaacagcagatggtcaggtgtataggcgccgctaaaatccatgttattcactctccttctctaataactttttccgagacgtctttccaaatagtgaaccccgatgctgagcgggatcgttaatatcaaataaaaaagcgcgacgaaaatatagacatcaaacacgacaagagtgctcgaggacacgagatccgcctgatacatcaaatcgagtcccgccaccactccgagtattgatgagtttttgacaaggttgagaaattggtttccgagcgggggaatgacgatttttacggcctgaggaagaatgatatatctcatcgcctgactgtaggtgaagcctgacgatctggccgcttccatctgccctttggggacagtctgaattccggctctgatggcttctgcgataaaggcggacgtgtaaatcgtaagcgcaatcgttcccgcctgaaagccgtccagtctcagcccggcgttcggaagtccgaaataaaaaacgaatgtgatgaggagaagcgggatgttacggataaattccacatacgcagtgccgatccattgaaggggtttgaaagccgtgattctcatgactgcgatcagaacgcccagcgcaaagctgcctgccagcgcgatgaagctcgcaagcaatgtgtgcaggaaaccgtccatatacatatcgaagttttccgttaaaattgaaaagttcatctatgtcactccttataaaacggggatgagcatgcatgctcatcccgcggtccgtcctattttgccggttcttcttttatccattttttatagattttttcgtacctgccgtcggctttcatttttttcaaagaggcgttgatttctttgacaaggccggattggcctttttgacggcgattccgtaaggttcatcggtaaaggtttcgcccgtcagctgatattgtttattttcatcggccatgccgtataaaatcgcattatcggttgtgagcgcatctccctgtcccgctttaagcgcagtgaacgcttcggcgtaattttcaaattccagcactgaggcgtcaggcgctttttctctgatgttctgtgaggaagtggagccttttaccgccaatacttttgagccttttcccaggtcttcggtgcttttgatgctgcttccttttttgacgagcagggattgcccggcttcaaaataaacatctgagaaatcaacttcttttttccgctcatccgttatcgtcatcgtggcggtgatggcgtcgatatcgccgttttgcagcatcggaatcctcgtttttgacgtcacttctttaaattccgctttcttctcatcccccagaatatcttttgcgagctgttttgagatatcaatatcgaagccttcaatatcaccggagcttgggtttttcagcccgaataacctcgtatcggttttgacgccgaagatgattttgtctctgtctttaatagaggctaacgtgtcttttcccgttccttttgaatccccggacgtttctttccctccgcaggctgccagcataaagacggccagcagtgatatcaatccgaatgacaaccattttgttgcgcgtgacataagcgctcctccgtttcttttcagtgatttaaaatacggcttaagaataaacgcgccctctcttcacgggggctttcgtaaaattcagccggtgcagcttcttctaagatggatccgccgtcgataaacacgatgcggtccgccacttcttttgcgaatcccatttcatgtgtgacgactgccatggtcatgccttcctttgcgagtgttttcatgacatccagcacttccccgatcatttccggatcaagcgcggatgtgggttcatcaaacagcataatttcgggcttcatcgcaagcccctggcgatggcgacacgctgctgctggccgccggaaagctgtgaaggataagcgtccgctttgtccggtataccgacttttttcaaatagtataaggccgtttcctttgcttcttcttttgattgcttgagcactttgatcggtgcgagcatgatgttttgcagaacggttttgtgcgggtacagatgaaaatgctgaaacaccatgccgatattccggcggacctgatttatatccgttttcttgtcacggatggagacgccgtttaccgttaaggcgcctccatcaactgtttccagctgattaatgcagcggagaagcgtgctttttcccgatcctgaaggtccgatgataacgacgacttccccttttttaatgtgcagattaatgtttttcagcacgtggaaatgtccgtagtgcttatttacatcctgaaatgaaatcatggccatcctccttaaaaaaacatgagtcatattgactggacagttttgaaatcctttaacacattacgatggttatacagacttttatgaatattatttagattatttcgtaatttctgataattatttccgtcaagaggtctgcgtcataaggcgtagtttatgaaacgggaataattccggctttctgtcaaaagataaagcaagaggtgaaacgtcatgcttcaaaaaccgctgcagctcttaatgtggacagctgtatgtctgctcgttttgttaacagtgtatgtcttttgcatgctcgatatgttatggtctcccatttggcttgttataaaatctctctttattcctatattcatcgcagtatttattgcttatcttttacttccgattactgaatggcttcatagaaaagggatgcctagaactttaagcctgcttctgatttattgcctgtttttcggcggaatcggctggggggtttataaaggggttcctgttttaattgaacagctgcaggatctgtctgagagcattcccggtcttgccgaaaactacaacagcatgctgaggcatctgcataatcacacggatcattggcctgacggcatgcaccatcggatggacaaaatgattcagcagacagaaacgtttcttgccggcacgattgaaagcacgatcagaagcatccgtttcgtgcttgattatatcctgatcgcggcgacgattccttttctcgtgttctatatggtgaaggatataggcgtcatgaaaaagacggtctggtatttgacgccgaagtcctggagaaaaagggggagtgaatttctgcgggatgtggacgactctctcggtgattacatccgcggtcagcttctcgtttgttttttgctcgggttaatagccggcgtttcattttggctcttcgggcttccttacccgctgattttgggccttgccatcgggattacgaatgtcatcccgtatttcggcccgtttatcggcgctgtgccggcgctgctcctttcgctggcgatttcctccaaggctgtgatcatcgtaatcgtcacgatttttattcttcaatttatagaaggaaacattttgagcccgctcattgtcgggcgaagtctcagaatgcaccccgtcgtgatcatgcttgcgcttcttgccggaggagagctcgcgggcattcccggcatgattctcgctgttccggcggcagccgttttaaaagtgacggccattcactttttgcggatcaggacggaacattgacattcgggttctgcttgtctataatttcgagtagaatacatacgaatctcgagtgacggataagagtacgccgaagccctgtttaagagagaagctccgatacgctgagaggagcttcagcagaagatcggccgaagctaatcctgagtgcagttaaaggctgccgcaatcctgcgttacgggatgaaaggtgacaggcctttttcggcctgtaatcagggtggtaccgcgagacagctctcgtccctgtgtgaacgcatggtttgcatagggagagagcttttttgctgtcgcaaaagagaatttcgggtagtgataaggaggaatatagatgaaacacttaacttctgctgaagtacgtcaaatgtttttagatttctttaaagaaaaaggtcatgccgttgaaccgagcgcctcattggttccgcatgaagatccgtctttactgtggatcaacagcggcgttgcgacgctgaaaaagtactttgacggccgcgttgtgccggagaatccgagaattgtaaacgcgcaaaaatcaatccgcacaaatgatattgaaaatgtggggaaaacggcgcgccaccacacgttctttgagatgctcggaaacttttccatcggtgattattttaaagaagaagccatcacgtgggcatgggagtttttaacgagcgaaaagtggatcggctttgatccggagctgctgtctgtaacggttcaccctgaggatgaagaagcttatacgctatgggcggaaaaaatcggcgttccggaagaaagaatcatccgtctggaagggaacttctgggatatcggcgaaggcccgagcggaccgaatacggaaattttctatgaccgcggcgagaaatacggtaatgacccgtcagattctgaattgtatccgggcggcgaaaatgaccgctatcttgaagtatggaacctggtattctcagagttcaaccacaacccggacggcacgtacacaccgcttccgaagaaaaacattgatacgggcatggggcttgaacggatggtctccgtgattcaggatgtcccgacaaactttgacactgatttgtttatgccgattattgaagcaacagagcgcatttccggagatgcttacggaaaggacgcaatgaaggatacggcctttaaagtgatcgccgatcatatcagaacggtcgcatttgcggtaagcgacggagctctgccgtcaaatgaagggcgcgggtatgtactgagacgcctcttgcgcagggcagtgcgatacgcgaaaaccatcggtatcagccgtccgtttatgtacgagctggtaccgactgttgcaggaattatggacgctttctatccggaggtgaaagaaaagcaagagtttatcgccaaagtcatcaaaacggaggaagagcgcttccacgaaacattaaacgaaggtctggccattttatctgacgtgataaagaaagagaaggaaaaaggcagcggcatcatctccggaaaagacgtattcaaactgtacgatacgtacggattcccggttgaattgacggaggaatacgcggaagatgagcaaatgaaggttgaccataaaggctttgaagccgaaatggaaaaacagcgtgaacgggcgagaaatgcgcgccaagatgtaggaagcatgcaggtgcagggcggcgcattgcgcgacattaccgcagaaagcacatttgtcggctacagtgccgtaaaagctgaagcgaaggtgatcgagcttcttcatgacgggcaattaatcagcgaggcgcatgaaggggataccgtccaaattcttcttgacaaaacgcctttctatgctgaaagcggcggacagatcggtgacagaggagtgctgagaagcgagcaggctgtcgtaaccattaaagacgtgaaaaaagctccgaacggccagcatgtacacgaaggcacggtggatagcggcacgattcaaaaaggcgcaagcgtgacggctgaagttgaagatcaaatgagaagcggtgtggtgaaaaaccatacagcaacccaccttctgcaccaggcgctgaaagacgttctcggcacacatgtcaaccaagcgggttcactcgttaccgaaaatcgtctgcgttttgacttctctcatttcggtcaagtgacgaaagaagaacttgaacgcattgaaggaatcgtcaacgaaaaaatctgggagagcattccggtagcgattgatttgaaaccgatcaatgaagcgaaagaaatgggcgcgatggccctgttcggcgagaaatacggcgatatcgtccgcgtcgtacaagtcggagattacagccttgagctttgcggcggatgccatgtcacgaatacggctgaaatcggtctgtttaaaatcgtatccgaatcagggatcggcgcaggtacgcgaagaatcgaagccgtaacaggaaaaggcgcttatcaggaaatgaacagccagctcagccttctgcagcacgctgcggatgagctgaaatcaaacgtaaaagacgtaccgaagcgaattcagtctcttcaagcggagctgaaggaagcgcaaagagaaaatgaatcattgctcagcaaacttggcaatgtggaagccggagccattctgtcaaaagtaaaagacatcggcggcgtaaaagtgctggctgaaaaagtaaatgcgaaagacatgaaccaccttcgtactatggtggatgatctgaaagcgaagctcggttctgcggtcatcattctcggcgccgtgcaaaacgagaaagtcaacctttcagcaggcgtgacgaaagacctgattgaaaaaggccttcacgccggcaaaatggtcaaacaagcggctgaagtctgcggaggcggaggcggaggccgtccggacatggcgcaggccggcggaaagcagcctgaaaaattggaagaggcgctcgcatctgcggaagattggataaaatccgttttataatcctttcaactagtgtagaatgatgataagatgaggacctcaggctgaactttgcctgcgaatttgggaaagaggtgcaaaacggtgagctcgtttgataaaacgatgaaatttaatttctccgatgattctgctgaaacaaacgtcgaagaagtgctgattacggtatatgatgcgcttcaggaaaaggggtacaatcctatcaaccagattgtcggatacttgctgtctggagatcctgcatacattcctaggcatcgcgacgcccggaacttaattcgcaaactggaacgtgacgaattaatcgaggaattggtaaaatcctatctagaacagcataaagaggcgtaaatacattcatgagaatattgggacttgatcttggaacgaaaacactcggcgtagctttaagcgatgaaatgggctggaccgctcagggcattgagacgataaaaataaacgaggctgaaggagattacggtctggaccgtttatccgagctgatgaaagactataatgtagagaagatcgtgctcggttttccgaaaaacatgaacgggacgatcggtccgagaggcgaagccagccaaacatttgcgaaactgcttgaaacagcgtacaatgtccctgttgtgctgtgggacgagcgtctgacgacgatggcggctgaaaaaatgctgatcgcggctgacgtcagcaggcaaaaacgaaaaaaagtcattgataaaatggcggctgtcatgatccttcaaggatatctggacagtttaaactaagaggtgaaagaaatggaacacggcgaaaaacatattacaattgtcgatgatcaaggcaacgaacagctttgcgaagtgctgttcacatttgaaaacgacacattcaacaaatcttacgtactttattatccgattgatgctcaagacgatgatgaaattgaaattcacgcttcaagcttcgaaccgaacgaaaacggtgaagacggcgaactgatgccgattgaaaccgatgaagagtgggaaatgatcgaagaaacgctgaacacgtttttagcggaagaagacgaagaataaaatgaacggaaaaagccggagcgcatatgcgcttcggcttttttttgtaataaattgccgaatgcacatgaatcatgtagtataagagctgttgggaggaaaatacttgtatgaatatcaatcagactaaaaattcatttccgcgtaaaaacaaaaaaacaacgataatactgtcctccgtgatcgctctgcttatcatcatttgcggtgcttttttctatggaaaatctctgctgtccccggttgacaaaggcagcaaaacggcagtcaatattaatattccgagcggttcttccgtttcggcaatcgctgaaattcttgaggatcagcatgtcatcaaaagcaaaaaagcatttcagctgtatgtgaagtataaaggcgcttccgggtttcaggcgggattttaccacctgaataaaggaatggatgcggatgcgattatcaaaaaactgaccgcgggatcaacgggatatgcctttcagatctccgttcctgaaggaaaacagcttacacagattgcggatgcgatcgcaaaagaaacatcatattcaaaagaagagatcatggcaaaactggatgacaaaacattcatcggcaaactgaaaaaacagtttcctgatacaataacggacgcactttcaaacaagaagctcaagcatccgctcgaaggctatctgtatccggccacatatccgtttaatgatccggatgcatcgcttgacacgattttgacggcaatggttcaggaaacaaatacccgtatcgaaacgtataaatctgaactggaaaaaaagaaactttccgtccataacgcgctgacgatggcatcgcttattgaagaagaagccaccgccaaagccgaccgtcacaaaatcgccagcgttttttacaacaggcttgcagaaaaaatgccgctgcagactgacccgacggtattatatgcggccggtaagcataaaagccgggtctactacaaagacctgaaaattgattctccgtttaatacgtataaacataaggggctgccgccgggaccgattgcaaatgccggtgattcatcatgggaagcggctctccgccctgacaaaacggattatctctatttccttgcaaaaccaaacggcgaggtcgttttcaccaaaacattaaaagaccataataaagcgaaggaaaagtatatttccaaaaaagacagcgaataaaaggagggcaaaagctctccttttattccattctgaaaggttttatgataaaatatatcgggttgtttacttatggataaagaagtgtcttaagagagtgtccccgcggattcgtcaggggcactcctttttagaacggaggctgtttgccgtgaatgatcggtatgaacaaataaacgagtatataaacgcgatgctgaagcctcggcctgataaagtgaaaaagcttgaagcctatgcaaaagagcaccatgttccgattatggaagaagcgggcattgaagtgctgcttcaaatgctgtcgattcaacaggcgaaaaacattttggaaatcggcgcggcaatcggatattccgccatacggatggcgcttgagcttccggatgcgaatatttacacgattgaacgggacgacaaacgctatgaagaagctgtgaacaatataaaagactttgaaatggaaaaccgggttcacgtaatgcacggggatgcgctggaactttctgagtctgtccgtgtcacggctccttatgatgccatttttatcgacgcggccaaaggccagtacacgaacttttttgagctctatgaaccgatgcttgcgccggatggagtcatttttacagacaatgttctgtttaaaggactggtggcacaaaatcactcggacattgagccgaaaagaagacggaagcttgttgaaaaaattgatcaatataaccaatggctgatgaaccggcctgactatcaaacggtcatactgccggtcggagacggcatcgccatcagtaaaaagaagaggtgaatgatcatgaaaaaacctgaacttttggtgactccgacttctgtacaggatattcttccgctcattcaagcgggcgcaacggccctgttagtcggagaacagagatacggcctgagactggccggtgaattttcaagagaagatataaaagaagccgtaaagacagctcatcaggaaggcgcgaaagtgtacgccgccgtcaatgctatttttcacaacgaaaaagtggacgagctgaacggctatcttgcctttttgcaggaggccggcgttgatgcggctgttttcggtgatccggccgttttaatggcggcgcgtgaagcggctcccgatcttaaactgcactggagcacggaaacaacgggtaccaactactattcctgcaattactggggacgcaaaggcgcacggcgggcagtgctggctaaggaattaaatatggacagcatcattgacataaaagaaaacgccgaagttgaaattgaaattcaaatccacggcatgacgtgcatgttccaatcaaagcgttctttagtgggccattacttcgaataccagggaaaagtcatggacatcgaacagaagaaaaaagaagcgggaatgtttctgcatgacaaggaacggggcaataaatacccgatttttgaagatgaaaacggcacgcacatcatgagcccgaacgatgtgtgcatgattgatgaattagaggacctgatggacgccggcatcgattctttcaaaatcgacggagttttgaagtctcctgaatacttaactgaagtgacccgcatgtacagagaagcaatcgatctgtgcttcgaaagccgagagacatacgaagagaaaaaagagagctggatagagcggattgaaagcattcagcctgtgaacagaagcatcgacacaggattcttctttaaagaaacggtctattaaaaaggagggtgcaacggatgacagccgtaaatcaaaccatttccaaagtcgtaaacggaaaacgcgtcattacgaaaaaacctgaactccttgctccggcaggaaaccttgaaaaattaaaaattgccgttcattacggagcggacgcggtttttatcggaggacaggaatacggactccgctcaaatgcggataacttctcaatagaagaaattgcagagggcgtagaatttgccaaaaaatacggggcaaaaatatatgtgacaacaaacattttcgcccataatgaaaatatggacggtctggaagaatacttaaaagcgttgggagacgcaaaagttgccggaattatcgtcgctgatccgctgattattgaaacatgccggagagtggccccggacgtagaaattcacctcagcacacagcagtccctttccaactggaaagcggtgcagttctggaaagaagaagggcttgaccgcgtggtgcttgcccgtgaaacgagcggactggaaattaaagaaatgaaggaaaaggtggacattgaaatcgaaacctttatccacggcgccatgtgtatcgcttattcaggacgatgcgtgctgagcaatcacatgacagcccgggattccaaccgcggcggctgctgtcagtcctgccgctgggattatgacctgtatcagacagacggtgcaaacgcggtcgcgctttatgacgaagaagacgctccgtttgcgatgagcccgaaagatttaaaattgattgaatccattccgcaaatgattgagatgggtatcgacagcctgaaaattgaaggccggatgaaatcgattcattacgttgcgacggttgtcagcgtgtatcgcaaagtcatcgacgcatactgcgctgatcctgaaaactttgtcattcaaaaagaatggctggatgagctggacaaatgtgcaaaccgggataccgcgcctgctttctttgaaggcacgcccgggtatgaagagcagatgttcggcgaacacggaaagaaaacaacatttgattttgccggtctcgtgctcgcgtatgacgaggaaactcaaatggtgacgctccagcagcgcaatttctttaaacaaggtgacgaagtggaatttttcggtcctgaaatcgacaatttcacattcacaatcggcactatttgggacgaagacggaaacgagcttgatgctgcccgccatcccctgcaaatcgttagatttaaagtagacaaaaagatttatccgagcaacatgatgagaaaggggaagtaatcaccaatgggtaagagtcctgtagttataggcatcgcaggaggttccggatcaggaaaaacaagcgtcacccgttccatctatgaacagtttaaaggacactcgattttaatgatccagcaagacctttattataaagaccaaagccatcttccgtttgaagaaaggctgaacacaaactatgatcacccgctcgcatttgataatgactatttaatcgagcatattcaagagcttttgaattaccggccgatagaaaagccgatttatgattataaactgcatacgcgttctgaggaaaccattccggttgagccgaaggatgtcattattctggaaggcattctcgttctcgaagataaaagacttcgcgacctcatggatatgaaactttatgtcgacacggacgcggatctccgtatcatcagacggattatgagagatattaacgaaagaggccgttcaatcgattctgtcattgagcagtatgtgtccgtcgtcagaccgatgcacaatcagtttgttgaaccgacgaaacgctacgcggacatcattattccggaaggcggacaaaaccacgtcgcaattgatctgatggtcacgaagattcaaacgatccttgaacaaaatgcaattttgtaataccatagcatagacataaataactcagaccatattatgtataggctggaagggaatgagacagttcccttctttccctgtttataaaccgaaacatttgcagaaaacacacattcagtttaagataaacagtacctatatgggagagaagaacgaggactgccctgtgttctcattcttgattttttcgtttatgctctcatacataatcacacgttattgttgagggacaaccaccaaggagtgaaggaacatggcacaagaaaaagtttttccgatgactcacgaaggaaaacaaaaacttgaacaagaattagagcaattgaaaacggttaaacgtaaagaagtagtagagcgcattaaaatcgcaagaagcttcggagatctgtcagagaactctgagtatgattccgcaaaagaagaacaggcatttgtggaagggcgcatcacgacgcttgaaaacatgatccgcaatgcgaaaatcatcgaggacgacggcggttcaaatgtagtcggtttgggaaaaaccgtatcattcatcgaattgcccgacggtgaagaagaatcttacacgattgtcggaagcgctgaagctgatccgtttgaaggaaaaatctcaaacgactcgccaatcgcaaaaagcctgctcggcagaaaagtggacgaagaagtgacagttcagacgccgggcggagaaatgctcgtgaaaattgtgaaaatttcataagatccgtttaacaatgaaacacctcgtccaaaatgtggatgaggtgttttttatgatcgtatcaaaaaggctgaaaacggccgtgatttgttttctgctcgtgtttttctttctgcttgcaaggctggctgaaattcagctgttttttacagaatctttttcaaaatccaatattaatctgattcaggaaagcgtcaagcagcggacggaagaagtccttatttcagacggccgcggctcttttcttgatcggaacggcaaagaactgaccggaaaaaagcagcctgccgtcatactgtttccctttctcgtgacgcaggattggccggttgaccgggtatcagacattctcggaatgaaacagggggagctcaggcagctgctgacggaagcaaaaaaaccggtgatcctgaacagcagaaaaataaaacatttgacgaaacaatccgtggcaaatatcaattctttgaaatatcccggcatttacggcgtatatatgaaagacagcaaagaaacaaacatagccgctcatctgttgggcgcgacaaaccaggaccctgagcttttgaaaaagaaataccccggcaggaaggaactgccgatcacggcaaaaatcgggacaagcgggatggagcggacatttgatgagtttttactggcggatcaggacacaaaacttttgtatcatgtcgacggaaggggaaaccctttattcggaatggacgtcaaatatacggctgaagcaaacgcgttttatccgctgcaagtcaaaacctccatcgaccgcaatattcaaaaagcaatggaagatgtattgaaagaccgcgggttaaaaaaggggggagccgtccttttagacattgaaaaaagcagtgtgctcggaatggtatcaaagcctgacgccgacatgtcaaagcagcagacactgcaaaattacatgctgacgccgatttatccgggatcagtgtttaaaacggtgatcgccgcagccgcaatagaacaaaacgaagtgaagccgggcacatcctttaactgcaatctcaacctgtacggagagccgggggatgataaaggcacgctcagttttggagaaagctttgcccaaagctgcaattatacgtttacaagtcttgcggaaaaattaatcaaaaaagatgattccgttattgaaaacatggcggagaaactaggtctcacacagcgggcgggctgggaaggcaagctgtaccgggaagacggattcagacagctgtataatgaaaaaagcggggtcatttggggagatgacaaagacaaaaccgtaaaaaaagccgtcgcacagacggcgatcgggcaaaaaaacgtgaaagtcacgcctcttgaagtcgccaatatgatggcggcgatcgcgcgcggcggtgagaaaaaacaagtcaaaatcgcggacaaaattgaatacaaaaacaaaacgacgatggcgtcattcaaagaacagccgttaaaaggggaaaacatcgacaaatatacggcgcagcagcttcaaaaaattctcagagaagtcgtcacctcaccgaaaggaaccggccgaaggtttcaggatctgccgtatgagatagcaggcaaatcgggaactgcccagacgggaatgttcacaaaagaaaaacagacgctttaccacaaatggtttgcgggatactttcccgcggacaagccgaaatacgctctcgtggtgctgcacatggacacgccgggggataaggctctgacaaatacagtgttttatgatattgttaaaaaggtacatgaaaatgaaacaaatcagacatagaacaaccgctcagcccatgttaaaatatatgctgagcaagagggataaaggagtgcagaatgattgagcaataaacaatctcgttttgaaaaccgtgataagcgcagaaaagcaaatatggtgcttaacattttaattgctatcgtatctattcttattgtcgtcgttgcagtcagcctcttcatcaacagtccgtcgagcgacgtgagcgaaaaagcggacacgagccagaagcaggaaacacctgcatcaggcaagacgaagcagacatccgatgaagacataaaagacagcaaaaaagatacggcatcagacgatgacaaaaaagataaacaggataaggacacatctgattcatcttcagactctgacagcaaaaaagacgatgattcatcgaaaagtgatgacagcagcaaaaaagactctgattcaagcgatccttttaaaggcgcaaaaataacagagggcggctcatcaagcgatgttgagaaaacaattgttaacccaaaatggaaagcggtcggaacaaagcagacgggagaacatgcggcgacgtatgactcaagctctgaagactggtccgaaatgcttgacgccatctcttacgcaacaggcgtgtcaaaagatcacatgacagtgctgtggctcggaaacaatggaagcccgcaagatgcgaagggtaaagttttagacaaaacgaacggcaaaaagtatcaggtcaccatcacttggaaagacaaaaaaggctggaagccgacaaaagtagaaacgttaaaataaccgcaaaaaagcagctgattattcagctgcttttttctgtcatacgtcagctgaaaaatgcaccgacgcgctgtaaaggattctgccgtcaacggccgtcacctgatgggatacagaacggacgcgaagcataatcgcctggttgttttcaatctgaacgtttattttcttttcaagctcctgcaaagatgccgcttcgaaaaattctactttatctttgattaaatccaattgaaaattcatcagtacagatcctcctgatttttcttctgagtcaatgaaagtataagcctttctgccgtaattgcgcaataatcccaaagtattttagtacccttccattcttttttgtgataggataggaactgttccacgattaatccatactatactcataggaattataaattatggagagtgaaaaatatgggccgtgaatttattccattatttgaagattgggcagcgacttatgatgccacagtgcacggggcagacaaacaatacgctgatgtttttaaagggtatgacaatattcttgacagcatcgtcgcactttcgggttctaacgttttagagttcggaccgggcacagggaatttaacggcgaaattagccgccgcgaacaaaaaggtgtttggtgtagaaccgtctccgtcaatgagaaaactggcggctgacaagctttctgacaaagccgtgttcagtgacggagattttctggagtttcccgctccgccttttcaaatagataccatcgtcagctcgtacgcctttcatcatttaaccgatgaagaaaagcaagcggctgtaaagcaatatggcacaatccttcagaagcatgataaaatagtgtttgccgataccgtctttaaagatcatgaagcttatgatgaaacaattaaaaaagcaatccgaaacggctatcatcaattagcggacgatttaaagacggaacattatccgacactcgggacaatgaaaaacatcttttcagaagagggatttgccgcgcggtttacgcagcaaaatgactttgtctggataatggaggcgattaaacggtaaatcgaagggattgtgtataaatgaaactggcagtcatcggagcaatggaagaggaagttacgattttaagaagcaaactgaaagacgcaaaacaagagatgatcgctcactgtgagtttacgacgggcagctatgaaggcgtcgaagttatcttgctgaaatcggggatcggaaaagtcaacgccgcgatcagcacgacgcttctgcttgaccgtttcaaacctgattatgtgattaacacaggctcagcgggcggttttcatcatacattgaatgtaggcgacgtcgtcatctcaacagatgtccgccatcatgacgtggatgtgacggcgtttgactatgaatacggacaggtgccgggtcttccggcagcatacaaagctgatgaaaagctgatcagtattactgaggaagcggtttctgaactgaacggcattcaagtcgccaaaggcacaatcgctacgggagattcttttatgaatgatccgaagcgggttgaagacgtacgcgccaaatttgcggatttgtacgcggttgaaatggaagctgcggctgtcgcacaggtgtgccaccagttcaaaacgccttttgttgtcatcagagctttatctgatattgccggaaaagaatctgacgtttcatttgataaatttttagaacaggctgccgttcattcaactgagcttgtcctgaatgtcatcaaacgaattcactaagcgggggattctcgttctcctccgcttttccaggaggaggacatatattgaacgtgataacagatattacagaactgatcggaaatacaccgctgctccgtctcaagcattttgatataccggagggaacagcggtttatgctaaacttgagatgatgaatccgggcggaagcattaaagacaggctgggcggaatgctcattgaagatgcgctacgcacgggaaaggtgaaaccgggcggtgttatcatcgaagcgactgccggaaacaccgggatcggactcgctctgtgcgccagaaagcatcagcttcgcgccgttttttgcgtcccggagcatttcagcagagaaaagcagcaaattatgaaagctctcggagcggacatcgtgcatacgccgagagaagaaggtatgcagggagccattcgaaaagcgcttgaactggagagagagattaataattcttatgccgttctgcaatttaaaaaccgagtaaatccattgacttactataaaacgatcggacctgaaatatggaacgcgctcggcggggatatccacacctttgtcgcaggagcgggttccggcggcacctttgccggtacggcagcttatttaaaggagaaaaatcctgccgtcaaaacggtgatcgttgaaccggaaggctcgatcctgaacggaggagagccgcatgcccataaaacggaaggcatcggcatggagtttatccctgattatatggacgagaaccattttgacgccatttacacagtggaagacgatacggcgttttcgcttgtcagagaagcggccgagaaagaaggcctcttaatcggaagctcttcaggggcggctctttatgcagcgcttgaagaagcgaaaaaagcgcccgccggatcaaatatcgtcactattttccctgacggcagcgatcgatatataagcaaaaacatttttcaaggaggtcagtaagatgaagaaaaaaacgctgatggtgcacggaggaattacgggagatgaaaaaacaggagcggtttccgtaccgatttatcaagtaagcacgtaccggcagccgaaagcgggcgagcatacgggttatgaatattcaagaacggccaatccgacgcggacggcgcttgaaagcttaattgcggagcttgaaggcggcgcggcgggatatgcgttcggctcaggcatggctgcgattactgccgtcatgatgctgtttgacagcggcgatcatgttattttgacggatgatgtatacggcggcacttaccgggtgatgacaggtgtgctgaaccgcttcggtattgaagcggactttgttgatacgagcagtgaagaaaaagtcaaaaaggccattcgcccgaatacgaaagccatttatatcgaaacaccgacaaacccgctattgaaagtgactgacctcaaactgatgtctgacatcgcaaaagaagcgggcgtattgcttatcgtcgataatacattttacacgccgtatttccagcagccgctcagctttggcgcggacatcgtgctgcacagcgcgacaaaatatctcggcggccacagcgatgtcgtcggcggcttagttgtgacggctgataaagagctcggtgaaaagcttcattacgtgcaaaactcaacgggcggcgttttaggaccgcaggattcatggcttttaatgagaggcattaaaacactgggactcagaatggatgccatcaatcacagcgccgggaaaatcgccgagctgcttgaagcgcatgatgccgttcagacgctctactatccgggatcagcgaaacatccgggccatgagctgacaaaagcgcaaagctccggtttcggcggaatgatttcctttgatatcggcagcagtgaacgcgtcgacgcgtttttagaaaaattgaacctgtttacaatcgctgaaagcttaggagcggttgaaagcttaatctccgtgccgtccagaatgacgcacgcttcgattccgcgcgaccgccggcttgcgcttggcattaccgacgggcttgtacggatctcagtcggtattgaggatactgaggatttaacggcggatgtgaaacaggcgcttgattcccttttataaagaatggatagatttacattctctgtcggctgtcagcttgtattataatgttggtagactataaaactggcaggtgaccttatatggagaagaaaagactgaaatcattaatagaagattttaagcattacgcatttattctgcttgcagtcagcaccttcatttatatcggcgcggttcttcccggacaagggctgactgcgggccagaaaatgctgatgtttgtaacggattgtgcatttttagcgggcgcttatttctgcgttgaccgttcacttatttataaaaagaggctggaagaggccgaagaataaaaaaagccattgtcttttgacaatggctttttcatttcttattcagaaggggtttcgcgtaattcttttcccattccttttaaaaactgcagcccgaagccgagcgcgcggttaatatcaggatcaccgacggctttcatcagttcaaacatactgactttcctgtcctcttttaaaaatctttgcgcctggtccgtcccggccatggcgctttctaaaagtctgcccataaattcgggatcagcttttgacagcgcgcctcccgcggccatcatcgtattcaggagattggtgacaggttcccgggaaatctgtccgagtgcgattttggcaatctcctcttttgcctggagcatatagccggcggcatcaaaaatgcccaagccattcagctctgccataatggacatcgttttcgcgacggcttcttcattttctgcgagaagcgtcttcagttcttccagtttttcagctttcagctgttcctctgttttcgtttctttttgaatttcagtaattgggcttgccattatgtttcctcctttccttaatcagttaggtgcacatagcccggacggttccattttcgctgagcttccacaccgttttgcggatgacgttttttgttccgcggattcgttttcggaagcggcggtgtatcacaggaaccgagcacttccatgcggacttttgtctgtttataggcaggtgtatgtgtccgtgaatcatacgcaggcccggtcaggaaattaatcgcagaatctttatctgtagagttcatcggcagataaagctcatttgcgcggacacggtctgtcacaagcgcattcaatttaaccgccccaaaaggagagacgagccggatcattgttccgtcgcaaattccgcgttcagccgcgagctccggcgatacttcaacaaatacatccggaactttagactgaatgccttttgacttgtttgtcatgtttccttcgtggaaatgttcaagcatccgtccgttgttaatatgcaggtcatattcttcagggaatacggcaggctccacccaatcgctcagcgcaaaacgggcttttttgtccgggaagttaaagccgtcttcataaagaagcggagtgctctctcccgtaaagcttccccacaggaagctgttccagccgctaagaacgtcgtagcttgcttttccgaacagcggagaaaggctcgccatttctgagaaaatgtcgcttggatgcgtgtaattccaatcagcgcctaaacgattggcaacctcctgaataatccaccagtcgggtttggcatcgccgagtgtcggaagcgcctgatacaatctttgtacacgacgctctgtgtttgtaaatgttccgtctttttcaagagatggaaccgcaggcaggatgacatccgcgtattgcgccgttcttgaaaggaaaatatcctgtacaacaaagaaatcaaggctggataaaatgtcatgaacatggttggcgtttgaatcgacgagcgccatatcttcaccgacgagatacatggctttcatgtttccttcttcaatcgcatggagcatttcaatattatcaagacccggcttgccgtcaatttcaacaccgtaagctttttcgaatttagcgcgtgccgcatcatcggtaatatgctgataccccggaagccagcctggaagagttcccatatcgcaagcgccttgaacgttgttatgtccccgcagcggataagctccggcgcccggacggcggtagtttcctgtggcaagcagcaggttggaaatcgccgctgatgtatcagagccgcctgtattctgggtaacgcccatgccccaaagaacacaagtgccgtctgcatcacgaatcatttcggcaatgcggatgatcgtatcctgagaaagtccggtgatgcgctccgcatattctaatgtatactttttcagcgtttctttataatcttcaaagtagttgacattctcatcaataaacgcttgatcgtgccagccttggtcaatcatatattttgtcactgccatgagccagacttggtcagtcccttgtttcgggctgataaagaggtcggaccgttcagccatttcatttctgcgcagatcggcaacaattaatttttgtccgtgcagcttatgtgcacgtttcacgcgtgtggccagaaccggatgtccttctgccggattggcgccgacgatgagcacgaggcccgcttttgcgatatctttaattgtgccggcgtcaccgcccataccgactgtgcggaataagccgtccgttgccggtgactggcagtagcgtgaacagttatccacgttgttggtttcaaatacttgacgcgctaatttttgaataacgtagttgtcttcattcgtaattttagaagaagaaataaaaccgacagaaccatttccgtgttcggccttgatcgaaccgagtcttgaagcgacaagatcaagagcttcttcccatgacgattcaacaaatgcgccgtttttccggataagcggttttgtaatccgttcttccgaatttacgaagtcccagccgaatttccctttcacacaagtggaaatcgcattaaccggagcatcggaaacaggctgaattttaaggatgtcacggccttttgtccatacttcaaaagagcatccgacgccgcagaacgtgcagactgtttttgtttttttcgtccgtttatcgcgcatagccgcttccacttctgacacggcgaagatgcttgtatagtcgggttcaacatttttcactaaatcaatcatcggttccatgacatcttcttttattcctgtcataaatccggcttggccgagcattgatttttccatcagtgcgttacaagggcagacagtgacacattggccgcagctgacgcaggatgattcattaatggggacgccttcatcccaaatgacccgcgggcggtcgcgctcccaatcaattgaaagggtctcattcacctgaaggttttgacacacttccacacattggccgcaggcaatgcattggttcggatcatagcggtaaaacgggtgagacatatcaaccgcgcactttgaatcatctttcggcgtatacggatatttctgatgctcaattcccatcatttccgctgtattatgcagtgtgcagttgccgttgttgttatcgcataccgtacagtaaagcaggtgattctcgagcaggcggtccatggcctctgtctgagcctcttttacccttcccgacgtaagcgagatggacatcccgttttctgcagccgtggaacaagagcgctgcaatttcccgtttacttcaacaatacaggtgtcacatgtttgaatcggatctacttccggtacatggcatatttgcggaatctcaattccgttttggtttaaaatatctaaaatcttagacccctctggtgcttcatactccgtgccgtcaattttgacacggatagactgaacgtctgtcacttccaattcccctccatcttttaaactcgaaaaaaagccatgcacatagataccggcctcctgtccggagaacggtataaatacgcatggcggaatagttcactagcaagtcttactaacagaccaatcctatttgtataaaacgatagactcataacacgtttcctattacaaatccatcttcactgcttttattataaggtgatatttattataatacaatacgaaaggaaaactttaaccaggtgaaatgtcacaaaggggaaccgggaatgtctttcataggctaaaatcggaggggacaatatgtctaaaaaaattcatgaatttaacgatattatccggaaattgcgcaaagaattatttggaaaggggccggaacgaattcacaccgtttttgtggataacatggcggtatcaacgctttacggcaatctaagcgcaagtgagcagtttatcgcacgcacgcctgaaggaagagaaatggttcatgcggcgcggaccagcttaattcaggaactgtattcaaaacaaacgcctgacggaatggaagagctcatcggagcaaagctcgtgcatctgttttcagacatcaagatcgaagagaatattgcggtgtctgtatttgtctttgaccgaacaattgaagagcgccgtgaagaaatcaaaagctgaaaaaaattcaattgacacgaaattgtcacatttgatatgatatgaactgcctgcagtggcttaaggacgaattttatggaatgtgtgcatgatctgtacattttctatagctgatattttcattctgcttgatattgttgtatgggtatgcatacaagttaggcagcattcaaacccgttttagacgggctgtttgaatgctgccttttttgttaggcgtctttggaaactgcggggctgaaatgataaatggaggggttattatggcttttcgtaaaccggacgaaatagcggagcttgcggtcgaatcaggggtaaaaaaggtgcattcaccgctttcagcactgattgtattaggatttttgggaggagcgtttatcgcactcggttatttgcttgatatccgtgtcatcggcgaccttccgaaagaatggggaagcttgtcgagtttaatcggggcgtccgtgtttcccatcggattggtgctcgtcgttcttgccggcgcggagctgattacgggtaatatgatgtcggtatctatggcgcttttttccagaagaatatccgccggtgcattagtgaaaaattgggtgatcgtgacgttgatgaatcttgtcggcgcactgtttgtcgcttactttttcggacatgttgtcggattaaccgaaacaggaccttacttggaaaaaacgattgcggtcgcacaaggcaaattggatatgccgtttggaaaagttattgtttcggcgatcggctgtaactggcttgtctgtttggccgtctggctttctttcggcgcagaagacggagccggaaaaatcgcgggtatatggtttccgattatggcgtttgtcgcgattggttttcagcacgttgtagccaatatgtttatcatcccggctgcgatttttgcaggttctttttcgtggggtgatctgattggcaatctcattccggcctttatcgggaatgtaatcggcggggcagtgtttgtcggccttatttattttattgcatattcaaaaaaagatcagaaaaagcaagggatgaaaagagtttcctgaggtaagaaagatgccggaaaacaaggacaattgaagcggaatgccagcacattttccgtccaaatcttgaaaaaaatgtttacaaaatggaagctgatggatatacttacaaagtaagaaaaaagcaaagggaggttgaatcacatgacgactttaaacggcaatcaaaatttacaattgaaccgattcagcctgtggaagagttcgtgtccttccttaacctctgcccgtcaagcacgttaatttcggagtatcaggacattcgcagctccccgcagggaaagaagcacgtcttcttttgtctgcggatttagtctgcccgcagcgcatatgaagtttgctgcgggttattttcgcttgtgcggatattgaaagggggtgagcgataatgaccattaatcttttctttttaacactgaccatttcaaagcgttttaaaagtgcggaagagtatgaacgagaacagcaggtcgaagagttttataatgaagcgaaagaacgccagctgaaacacttttatatgaactgaacggacacgaagggccaaaacggaggagaaggaggagatcatcatgttcagaattgaactgctgaatcattacacaatggagaaggaccaggtttagcgaggatgttgctgtcacgtcgcagacggcctgcataccatggtaaagaaagaaaaattggtaagcgggtgatagcatgcaaggcggtcagaacagaattccatccatcgggcacgggtatgcgtcaatgccccattcatttaaacacggctacggcaacccgtatcgccggcagagaatggcggcgctttcccggcagacaagatatatagcaccgtattattggtactagagcaggcggaaaacctacgttttccgtcttttttttatgaaaacaaatataaatttcaaataaatcgaaacgttcatgaagagaagtgcgtctagttagtacctcatactaatacgaggtaatattatttctgaataataaatcacaggaatggaaaagcgggtgttatacaatgttgcaacatacatcttcagcattaaaacgaatgcgcgcgaaatactttgctgcatcagaactggcagagtcagtcattcagcaaatcttgatggacatacaggaatacgaccgcattttggaaatcgggaccggaaacggctcaatgtttaaacaaatcatcggacagcttgaaaagggcagtcttaaaagcatagaaacatcgaaacgtaaaatacggaaaacacagcgcgcaaaccgttcggttataaaagccgggcgcggaaacattcagcaggggaggcctgaaagcttaccgttccgcgatcgcagctttcataaagttttctcattacatactgctgaaacagtcagcgattacaggacagcatgtaaagaagtgtaccgcgttcttcaaattgacgggtgtttctatatggttttgaaaccttcgcggatgagtgagaaggatgtgattgaggtgctctatgatcagcatttcagagacatttcagttgtcagcagagattcattccattttattactgccattaaatagaatatttcttgggaaataaaaagagctgcttaagtcactgcagctctttttgtgaaattgggcatatttccttatttttggttatttcacatctattttatattaaaaaaagtttttttcttatacaatggtaatcagatgaccgtacattttaaatgttttgaacaaacggaatgaatattcattccgcatctggaaagggggatgaaatgacagcttcaaacaaggttgaactcattatgaaagcgtcgcttactttgtttacagatagaggatttgacgcaacgacgattccgatgattgccgctcaggccgatgtcggaaccggcacaatctaccgttactttgacagtaaagagacacttgtgaacgtactgtatcaggaaagtgcgcagcgttttatgaaaaaagtcaaaacggactttcagggtatctctgtaagagaagggtttcatcacctgttttattgtctgattgattttacgaaggaaagtgagtatgcattgttttttcttgaaacgaataaggacgcctactttctgaatgaaacgagccgtaagcttcttgatgaaataacacagatgcttgacgtcttttttcagcgcggcaagtctgaaggtgtgctccgcaatctgccgtccaatgtgctgatggcgctgctgctcggggcatatctcaaactctatcagcttatccggacgggaagcgtcgaaataacaaaaccgtttctgaaagaattggaacaatgttcttgggatgccatcagaactcattaactattcgccgaaggaaggaagatcgatatgaaacagctaagcgctataccgcagccgaaaacatacggacctctgaaaaatctccctcacttggaaaaagaaaaactgtcacaatcgctctggaaaattgccgaagaatacggcccgatctttcgtttcgaatttccgagctctgtcggggtcttcgtctcaggccgcgagctcgcggcagaagtctgtgatgaaaagcgatttgataaaaacctcagcaaagccttgctgaaagtccgtgagtttggcggtgacggactatttacgagctggactcacgaaaagaattggcagaaagcgcatcggattttattgccgagcttcagccagaaggcgatgaaaggctatcattcaatgatgcttgatattgccatgcagcttgtgcagaagtggagcagattaaatccgaatgaagaaattgacgttgccgaagatatgacgcgcctgacgctggatacaatcggcctgtgcggatttcattaccgctttaacagcttttaccgcgacacacagcatccttttatcacaagtatgcttcgcgcgctgcaggaggcaatgcgccaatcacagagacacagcctgcaggacaagctgatgatcaaaacgagacatcagttccagcaggatattgaagtgatgaatgaactcgtagaccggatcatcgctgagcggagggaaaatccggatgagaatctgtctgatcttttagcattgatgcttgaagcgaaagatcctgtaacgggtgaaaggctggatgatgaaaatatccgctatcaaatcattacctttttgatcgcggggcatgaaaccacaagcggactgctttcattcgcgatttactgcctgctgaaaaataaagataaattgaaaaaagccgttcaggaagccgagcgggtgctgacgggagagacacctgaatataagcagattcagcagctgacatatacccgcatggtgttgaacgagactttacggctgtatccgactgccccggcattttccctgtacgcgaaagaagatacggttctcggcgggaaatatccgattgcgaaaggacagccggtgacgattctgactccgcagcttcaccgggataaaagcgcgtggggagaagatgccgagctattccgtccggaaaggttcagcgatcccgcggcaattccggctgatgcgtataagccgttcggaaacggacagcgcgcatgcatcgggatgcagtttgccctgcaggaagcgacaatggtgctcggccttgtccttaaacactttgaactgattgatcatactgattatgagcttacgattaaagaagctttaaccattaagcccggtgattttaaaatccgtgtaaaaaacaaggacgtgtccaatcatcagcccgtacaaaaccataaagctgaaggcggcggtcacaaagaagaaacgaaagaaatcccgtcccacggaacgccgcttctcattctttacggatcaaatttaggaactgcggaaggaatcgcggaagagctggctgacatcggcagaagcaaaggattttcaactgaaaccggcccgctcgatgattatgccgggaaactgcctgtaaaaggcgcagtcgttattgtgacggcttcttataacggggcgccgcctgataatgcggcgggttttgtgaaatggatggaaacccttgaagatcaggaattaaagggtgtttcttacgccgtcttcggctgcggagaccgtaactgggccgccacttaccagagggtaccccgcctgatagacaaagtgcttgaagaaaaaggggcaaaacggctgacttctatcggggagggcgacaatgccgatgattttgagtacagtcaggaagcctgggaagactcattctggaaggacatcatgaaggcttttcatatagaggccgctccaaaacaggcaaacaaatcacagttatcaatcgaatacgtaagtgaagcagccgagacgccgattgccaaaacgtacaaagcatttgaggcggaagtcatcacaaacaaagagcttcataccgaaagcagcaagcgttcagtccggcatattgagctgcgtctcccgaagaccgaaacgtatcgggaaggagaccatctcggggtgcttccgcaaaacagcggggaactgatcagccgtgtcattcgccgattcggtctcgacccaaatcagcactttaagatcaagggccggcagctgcctcatctgccgatggaccggccggttaatgcgccggagcttttggcgtcatatgtagagctgcaggaaccggcaacgagagcccagcttcgcgaacttgccgcccataccgtgtgcccgccgcaccaaaaagaattggagcatctttattctgacgatgcggcatataaagaaaacgtgctgaaaaaacgaatgaccatgctggacctgctggaagattatccggcgtgtgaactgccgtttgagcgctttttagaacttctgccgtccttaaaggcgcgctattattcaatctcaagctcaccgaaggcaaacaaaagggagctcagtatcacggtcggcgttgtgacggctccggcgtggagcggccggggagaatacaagggcgtggcttcgaactatttagccggattacaaaatggcgattctgccgtctgtttcatccgctcgccgcagtcgggtttcgcattgcccgaaattacgaaaacgcctctcattatgatcggagcaggcaccggaattgcaccgttcaggggatttatccaggcgcgggctgcagaaaaaatgtccggtaacagcctgggcgaagctcatttatacttcggctgcagacaccctgaagaagacgatctgtacaaagatgaattcgaccatgcggagaaaaacggccttgtcaccgtgcatcgggcgtattccagattagatcaggactgtaaagtttacgtacaggatgtcctgcttcgcgaggctgcacagattattgcgcttcttgaccaaggcggccatctctatatatgcggagacggaagcaaaatggctccggctgtcgaaaatgtactgcttcaggcgtatgaaaaggtgcataacactgattcaaaagtttcctcgaattggcttgaacagctgcaggcggaaggaagatatgcgaaagatgtttgggcaggtgtgtaacagaagcgtaaggcaattgaagattgtgttttaattgaagaaagccggcacgatatttgaaatctactgaatcaaaaggaatagttatagggagtatcgtgccggccttatctttagtatcggacaaaagacacaaatctttaatgtttttattgatttacatgcaggcggctatgtcccttttttctgaattccgccagaaataaaaccggataagacagcaatagcaaaaccgaaataaatgaaatgataccgatccaatgaaaatgcgtccaaaagaaaccgccgcaagacccggccgcgcttgacccgatatagtatgcaagcagatataatgaagaagcttgcgcgcgctgatcaccggctgctcggccgacccaggcgcttgcaattgaatgtgcgccgaaaaagccgaaggtaaacacggcaatgcccgcaattttaagggcaagctggggcaaaagtgtcaccgctgcgccggcaagcataacaaaaatcgcaatcttaatcatttttgcacttccgaaaagatctgcttttttccccatatagacagagctgaacgttcccgcgagatagacaataaaaataaaaccgattacagtctgtgacaaatgataaggagccgccattaaatgaaagccgatataattatataatgtcacaaaactccccattaatataaatcccagagatattaacaaaagcagccgtttgcggtgtagaaccgctccgtattccttacatgccgcttttacgcccgcatgccgctgagatgaatggcgcggagccggaagaaaacgccaaaacaaatagcttaatataatagaaagaatgccgataatggcaagcgccggccgccagccgaatacatcagtcagaagccccgttaacagcctgccgctcattcccccgatgcttgtgccgctgatatacaggcccatcattttcccgaggcccttcggatcaaactcctcgcctacatatgtcatagcgacagcaggaacgcctgccagaaaaataccgagcagccccctcatcgccaaaagcgccggaaaagccggactgaacgctgttaatagacctaaaacagaagtggctgttaacgacagcaccattaatttttttctgccgaatccgtcagacaacgaagcagcggccaataatgaaaatgccaaaacggctgttgagatggataaagttaagctggcagccgcagcggaaatatgaaactcttccgaaaacaaaggcataagcggctgtgtcgtgtaaagcgtggcaaatgtcacaaagccgctgataaacagtgccaagctggcctttctgtaagcctttgtatgaggctgaataaacgtcatgaatgtccctcttttctcactgttggttatatatgtatcgtacgcttttcatttcaatgtgtctaatttataataactatagaattaatgcgtgtaggttatgaagaaaggggagaaggagaaaatggagcttcatcaaattgacaacttcattgcggcggcaactcatcagcatttcacaaatgcggcaaaagaaagaatgatttctcagccggcattaagccgatcgattatcaggctcgaagaagaattaggcgcgccgttattttacagagagacaaaagccgtccggctgacaaggcacggagagcagttcttaataaaagcaaaacaagcgagacgagctttaaatgaaggcgttgaacaagtgaaaaaaaatatgagcctggagcacggcgaaatatctgtatcttttcttcatacgctcgggttgcgcttgatgcctcagctgattgccgaatttaaaaagctatacccaaacgtgaccttccggctgtatcaaggcgcaaatgaaacgcttcgcaaaatggtggaaacgggagatgcggatatctgtctcagctccccgccgcttcccagcgagcttttacaatggacagtgctggagaaagagcctctttatgcggtgcttcctgagaaccacccgcttgcagaaaataaaagcattcaaatgaaagagatgcaggacgaggattttgtcggatttaaaccgggatacgggctgagatatatgtttgatctgatgtgccgggatttgaatatacacccgcatctcgcatttgaaggagaggaagtgtcaaccatattagggctgaccgccgcgggtcttggggctgcagtgctgccgaaaaccgcggagcattcatactttccggtcgtttttctcccggttgcagattaccaatgcgaacgcaccatagcgttagcccagttaaaaaaccatgctctctctcccgctgctgagcgttttaaacagtttgcacttgattattacaaagcacgcaactgagcggtcattttattaaaatcgaagttgaaaataaagcagaaagaaatacagaaaacggaggataaccatggcgaaaaaaacagtgaaaacaaatgctgtccgtatcattgagcagcaaaacattccctatgagctattaggttacaaaacagaagggggacagcccgcagacggtctttccgtttcacaaaaaatcggatactctgccgaatatgtttataaaaccttagtggcatctgcaggaactgatcgttattacgtctttgtcgttcccgttgcaaaagaactgaatctgaaaaaggctgcgaaggcggcaggtgagaagaaaatagaaatgattgccatgaaggaccttttgggagtgaccggctatatacgcggcggctgctctccgatcggaatgaaaaaaaggtttcctacttttattgatagatccgctgaaacactggcgtttatgattgtcagtgcggggaaaatcggaatgcagctaaaagtagcgcctcatgatttagccgaagcaagcggggcggtatttacagacattgtataaatgtccggtggatctaatggaatacacgtttcaagggagaatgataatgaaaaaaagatatgaaaacttgaatggcgtgaagaatgaacatggattcatggacatgtggaaatggatgaaagaacgaagagaaaaaagtaaagatttaagcgagaatattccgaaagcggtcacaagggatgtccgtgatgttgccgtcaatcggacggaaaccgccataacatggatcggccattcttcatttctgatccaaatacaggggcttaacataatgaccgaccctgtatgggcgcggaggatgggttttcaaaaacggctgacagagccgggatatgaattgagcgaactgcctgacattgatgccgtgctcatctcacatgggcattatgaccatcttgattttccgagtataaaaaaactgagaggaaacccggatttttacgtgcctgcgggattgaaaaagctgttcatcaaaaaaggccgcaaaaaggttcatgaaatgaattggtggggtcgttttgagatgcggggggtgaatatatcatttgttccggcccagcactggacccggagaacgctttgggataccgatacttctcattggggaggctgggtcatagaaagcgaaaacggcgagtccatctattttgcaggagatacaggctattttgaaggctttaaagaaatcggagagaggtttcgtattaaggcggccctgatgccgatcggagcatacgaacccgaatggtttatgaaagtgtcacatatcaatccggaagacgccgtgaaagcttttttagagctgaaggctgacagcttcattcccatgcattacggggcattccggcttgctgatgatacaggcccggaagcattaagcagactgcacggtgagtgggaccggcttgcattacctcctgaaaacctgagagcattagcgcttggcgaaacattttggctgtaacagcaggttttcgctgccgacaccaatcgtttaaaaacggttggtgttttgttgtcaaccaaaggtgaacagcctcagtataaaacatgatttttccggaatctgcggtaaaaaacaaaactttttactcttttgtttcactatacaatgaaaacggtttcgtatgcgcggtatatttaacctatcacaattgctccagcagaaacggacaggaaggatagaaaaacagatgaaatacatgaattcaagacagaaaaagattttgtatctgttgttatctgaacctgatgactacttagttgtgcaagatttcgcagacagggtccgctgttctgaaaaaacgatcaggaatgatttgaaaacgattgaagatttcctgaatgaacatgctcaagctcagctgatccgtaaaccgggattaggcgtctatttacatatatctgaacaggaaagatcacggttaagccggcacatttataatgagcactttacatgcaggcacaagaccgatgaagaaagaatacttcacatcgcttatgatttattaatgaattcaaagcccgtttccgcaaaagaaattgccgcacagcattttgtaaacagagcttccattaaaaaggatatcagtgcggttgaagagtggctgaagcgatttgatctcacactggtttctaaacagcggctcggcttaaagattgaaggggacgaaaaaaacaaaagaaaagcattggcgcgaatttcagatttgattgataatgcggagtttacaagccaatttataaaaagtaagtttttaagtcatgaagcggactttgtgagaaaagaaatcaagttattacaaaaaaaccattctatctattttacggatgaaacatttgaaagtttgctgctgcatacattgctgaccatccgccgtatcaaaatgaaacagccggtcgccatctctgcaaggcagctggaggcggtaaaaaagaagaaagaatatgaatggacactggcttgtttaaaacggcttgagccggtatttgccatccggtttcccgaggaagaagccgtctatttaactttacatataataggcgggaaagtgcgctatccattgcagcaagaaaagaagcttgatcttgaagattctgagctttccaaagtcgtcaggcatttgatcaatcgcgtttcagaactgaaaatgctggatttccataaagaccaggaattgatcaatggattgaacattcatctcgatccggtgttgaagcggctgagctatgatctctctgtttcaaaccccatgctccacgacatcaaaaaaatgtatccttatttgtttcatcttatcattgacgttttagaagacatcaatcaaacatttgatctttatattcctgaagaagaggcggcctatttgaccctgcattttcaggcagcgatcgaacggctgcgccgaagcagtcataaccctaaaaggacgatcatcgtctgccatatgggcattggcatgtcgcaattgctgcggactaaaattgaacgcaaatttcatcacattacgataaaagactgtatcgcaaaagcggaactgacagagtatatcaaaaagcataaagatatagatttcgtcatttctacgatagggcttggaaatgtaacgatccctcatatcgtcgtatcaccgcttttggagcctgctgatgaaaagaagctcagcgcatttatgcaacagcttgatacatcacaccgccgggagcaaaaaacgtttaaaatgctgaatgatacgactccgtttctcgtttttttacagcaagagacagagcaccgttatcaggtcattgaaaagctggcgcaggctttgtatgaaaaaggctatgtagaaaaagagtatggcattcatgcagtaatgagagaaaaaatgtcggcgacaaatatcggggcgggtattgccatccctcacgcgaactctaaatatatcaaacaatcagccattgcaatcgccaccttaaaagagcccattgagtgggggacggaaaaggtgtcgcttgtatttatgcttgccgtcaaacacgaagatcaaaacaaggtaaagcaattattcagtgagctttcctatcttagcgagcagccggcatttattcaaaaactgacggaagaaaaaaatgtgatgacgtttttatcgtatttaaactattaaaagcaggggatggctccctgctttttttctgtttatagggaaaaatgccgttatttccggaacttatggtaaaaaaacgcgcttatcacaggctgatttcagtataaagttgagacaagatcttgaaattcagactgcaaaggaggatttatatgaaactgttagcgattacatcatgtccgaacggcattgcccatacgtatatggctgctgaaaatttacaaaaagcagccggcagattaggcgttgagatcaaagtggaaacccagggcggaatcggggtggaaaataggctgaccgaagaggaaatccgggaagcagacgcaatcattatcgcggcggaccgttcggtgaacaaagaccgattcgcgggaaaaaagctgctggccgtcggggttcaggaaggcatccgcaaaccggaagaattaattcaaagagcgcttagcggtgaagtgccggtctatcaatctgcttcaaaaactgaatccgcaagtcagcagggcaaaaaacaaaacccgatttaccgtcatttaatgaacggcgtttcttttatggttcctttcattgtcgtcggcggattattgatagcggttgcattgacgcttggaggagaaaaaacaccaaagggcttagtcattccggatgcgtctttttggaaaacgattgaacagatcggcagcgcttctttttcattcatgatcccgattttagccgggtacatcgcgttcagcatcgccgataagccgggtcttgtccccggaatgatcggcggatatattgcggcatccggcagcttttacgacagtgcgagcggcgcaggatttcttggaggaatcattgcgggatttttggcgggatatgcggcgcttggaatcaaaaaatgtaaagttcctaaagcaatacagccgattatgccgatcattattattccggtgtttgcctcactgatcgtcggtttggcgtttgtatttctgatcggcgcccccgtcgctcatattttcgcatcattaacggtttggcttgcgggaatgaaaggctcgagctcaattctcctggcattgattttaggagcgatgatctcctttgatatgggaggacccgtaaacaaggtggcctttctattcggatcggcaatgatcggagaaggaaattatgaaattatgggcccgattgccgtttccatttgtataccgccgatagggcttgggattgcgacgtttttaggaaaaagaaaattcgccgccgcagaaaaagaaatgggaaaagcgtcatttacgatgggccttttcggtatcacggaaggagccattccatttgcggcccaagatccccttcgtgtgatcccgagtattatggcgggttctatgaccggctcggtgatagcgatgatcggccatgtgggggacagagtggcacacggcggccccatcgttgctgtacttggagcagtagatcatgtattgatgttttttatcgctgtaacagcaggctctcttgtcaccgctctgttggttaatgtactgaagaaagatatggcgaaatcccccgcgcccggtgaggtgctgccgtctgccgcaccaaatgaagctgcagcggcaaaagaaacaaaggaaccatctcaggctgacagccgaaaagccgggatgaccgaaatcaaaaaactgactgacattatcagcacggacttgattgaaccgcatttatccggcgaaacgagggatgacattatcgatgaaatgatcgagaaattgtcccgtaaaggtatgcttctgtctgacagcggatttaaacaggccattttgagccgtgaacagcagggaaccacggcgataggtatgaatatcgccattccgcacggaaagtctgatgccgtcagaacgccgggtgtcgcattcggaataagacgttcgggtgttgactggaacagccttgatggttctgatgcaaaactgatttttatgattgccgtaccgaaggaaagcggcggaaatcagcatctgaaaatattgcagatgttatcccgaaaactgatggatgacagctatcgggaaaggctgctctccgttcagacaaaagaagaggcgtatgggcttctggaagaaatcgaataaagcgggggatgatcatgtctactgaaccgatatttttcaatccggttttcaaagaaagaatttggggaggcgccgccctgcgtgatttccactataatattccgtccgagcggacaggggagtgctgggcctttgccgctcatcaaaatggacagagcacagttcgaaacggcatgtataaaggatgtacgctcggtgaattgtgggagcatcacagagatttattcggaaaccttgaaggagaccgttttcctcttcttacaaaaattttggatgcggaccaagatctgtccgttcaggtgcatccggatgatgactttgccaaaatgcatgaaaacggggaacttggaaaaaccgaatgctggtatatcattgattgtgaaaaagatgcggagatcattttcggccacagcgcaacaacaaaagaagaactgatatccatgattgagcgcggagaatgggacggacttctgaacagagttaaggtaaagccgggagatttcttctttgtcccaagcggcaccgttcacgcgattggaaagggcacacttattttagagacgcagcaaaattcagatacgacttacagattgtatgattacggaagaaaagatgcggacggcaggctgcgcgagctccatttggaaaaaagtatagaagtgacagacgttccatctgtccgtgaacggccgaccgttcaatataaacaaacagatgatctgctggcagctgttttaatagaatgtccttatttttcagtcgaaaagtgggatgtaaaaggtgaagcgaatttattccagaatcatcccttccttcttgtcagcgtgatcgaaggagacggaataataattgcaggcgggcatgaacatccctttagaaaaggagatcacattctcctgccttccggtttgggagaatataaactggcgggccatgcaaagtgtattgtgtctcatctgtaatcttcaaaacccttctctggcagcagagaagggtttttcatcacttttacaaaaaggccgaaatttccgtggtccgttcctgaatttaatctctcaatttgtatatctcccgagccattgattcaagtatgtacatagcggggatttgggtggtgatattcgcattttcaacccattcttccgtcacgtaatatgaaatattcacatcagacattttggcaatggttgaatgtttatgatttgtaatactgatgacccggcttccttcttgtttcagctgattcagatgagtcaccgtagaatctccttcacctgaaaccgataatgcgatcgtgatgctgttatggcggaaatgggaatgggccggaaagtaaggatctttaatatacattgaaagtttccctaagcacgaaaaatatctggctccgtattcggcgagaattcctgaactacccactccgataaaaatgacgctttctgcatcggctgcaagggctgctgcttccttcagcttttcttccatccctccgcttactgttctttcaaaaaactcggcaacggaatgatggggactctttaaaatcgtttttttatttgcctccgcatacattttcagcttcaccttaaactccgaaaacccttcacagtttatttttttgcagaaacgtaaaatagaagccgtcgatacatgggtttcatttgccaattcacggattcgcatatagacgactttctcgctgttttgggagatgtagttgtataaagaagtttcaagctcgttaaatgaagcaatcatttcgtgtgtgaacatgcagggggattctcctttttatgagaatggtgaatgtacatctcatcgtaacatatcatttttaaaagaaacatagtgttatatttatgtgacaaatcactttttgtgtcattcaaaacaagacgtcagccaatgatttacggtgcaaaacaactgcggatataattcgttcatacgcttatgcatgatctcttcaagggtctctgacaaaagcggtcgaaaaaaggaggacaatatgagtatcaaactgatagcggttgatatggacggaacgtttttgaatgatgaaatggcatataacaaagagcgttttatgaatcagtatcgtgaattaaaagcgcggggaattaaatttgccgtagcaagcggaaaccaatatgcgcagcttacatccttctttccggaaatcaaaagtgaaatcgctttcgttgccgagaatggcgctttcgtcgtgaatgccggagaagaattattcgcgggtaacatgtctgaagacactataaaagaggtgatccgtgctttagagcagtatgaggtgaaaaacgtcattgtctgcggaaaaaaaagcgcgtatattcatgaaaatgccagtgaggatgaatatctgcatgccagtaagtattattatgtgttaaaaagggtgccgcattttgaaaacatcgatgatgacattttaaaattttccatcagttttcccgccgaacattgttccgcacttctgaggcatttaaaagacgccatcgggtctttcgtcacgcctgtatcaagcgggcacggtgacatagatctgatcataccggggcttcataaagcaagcgggattaggcttctccagaaacaatgggggataaatgatgaagaatgtgcggccttcggagacagcggcaatgatttggagatggtgtctgccgtgaaatacggagtcgctatggataatgcgcaggaaagcattaaacaggccgcggcgcatatcgcgcaatcaaacaatgaggaaggggtcttaaacgcgattgattccattctcaaatgtgaaaaaccctttgtctgaaaaagacattttaactgcggaggtgctgaacgatgattaaattagtgattacggatttagacggcacatttttaaataatcaaggcgattttgacagaacgttatttgaaaagacaaaacgagtaatggaagaacagcatgtcgctttcgccatctgcaccgggaaacagtgtgaaagggtggaagccttattcggagaagacgcgaaagatttttggattttaggagacagtgccgcacgtatgaaaaagaacggcaaattcgtatatgaatctttgatcagcaataaagccggactgtcaattataggcgctttagaaaaaatcagctgcgggcacaccattatcgcgtgcacaaaaaaaggcgcgatcgtaaaagaaaatctgtctgaaagtgaaatgaaatatgtaaatgcctcttatgcacatgtaacgaaaataactgattttactgagataaaagacgattttatcaagattacggttcatgaccccgacgccaactgtccggaaacgagagaaaagctgcatgaattttttcaccaattatatatcgtagcatcagaagatacctggatggacatatcaaatatcggaatacataaaggatcaacagtacaagaactgcagcgattattaggggtttcggctgatgaaacaatggcattcggagacggccgcaatgacaaagaattgatggaagcggcttcctacagctttgcggttaagaacgccattgacgaaataaaagatgcggcgcactttgtcatcaaatcaaatgacgaaagcagcgtcatgcacacgattatgagaatattagcgctgcaaaaacaatgagaaagcagatgggctaaagccaatgcggcaggacttactaggaaaagaaaaagcgggctatcctccgactttaaatcactcctgattttccgaaaatatgttaaaaatgaataaatatctatatttgacccaattgtattggtataatatgtataaaatgaatgaaacggcgtaatatcaagatgaaataaatcacttcatatcatttgatatcagacaaaaagtaggaacttcctcgttttgaaattgggaggtgtttgtattagcccgctgttgagtcccgcgtatatcattctcatttttcttccagcagcttcttttctgttagggattttaggatatttcatcttcaaaaaagtatggatgatggttgttattgtattcattttgtccttgatatttatgtttattgtaataggtgccgaaccgacatttttcatttgggtggctatgatgacggggagctgttttatctccggttcaatcactaagacggtatggacttttgtaaagcgaaaatattagacacagaagaatcctgtttgaacagctatccttttttgccgattgaagaaaaggaagtatagagtgatctgttatgttcttatattttgtctgttattgtattgtctgtgtatcgttttgttcttttttaactaaacggagcgctataattgaactgcagatatatagaaacacaaaaaaggataaggaggatttttatgtttcaaaccttagaccattttttgaaatcttgggaattcgaagccgatgcgacacaaaaactgctgaatcatctgactgatgaatcacttaaacaagaaatcacttcacaacattggactttaggccgtattgcatggcatactgtcgcggccattcatatcattacctcgaacacagatttaacgttccacgctccggctgaagattatcctgttcctgcatcggcgcggtttattgctgagagttatcatcaagccagtaatgcatttgtgcaggcgttaaaaacgcaatggactgacgatacacttcaagaatgtgtcaactttattggtcagcaattgccgaatggttcacttttgatgtttttaattcaacatcaaaaccatcatcgaggacaaatgactgtccttatgagacaagcaggtttacctgttccgggtatttatggtccggcaaaagaggaatggacaacatttggtttggaagctccgaaataggatgttgttgtaagggctcgaacgaatagatgataccaatcaatgttggtatcttttttgtattagtcttcgtgacatgcagacgaatcaacagttcaaaaggtgtaaagtgagttcaataactgcagaaaggcgattatgatgataactaaaatgactcaattcaatatgaaagacttcaataaaccaaacgaacctttcgttgtttcagggagaatcatcccttcatttgaaaacaatgtttggacatatacagaggagaaatttgctgaaccttatgtcaaaaaatatgacgatgaagacattgatgtcagttatgctgaagaagaggataaagttgtctttttttattacgcagagaacgactgtgtcggccggagtaagcttcgttctaattggaatggatacgcactgattgaagacattgccgttgcaaaagattatagaaaaaatggtgtcgggacggctttattacataaagcgattgagtgggcaaaggagaatcatttatgcggtcttatgcttgaaacacaagatattaatgtttcagcttgtcatttttatgccaaaaataactttgtcataggagcggtcgatacaatgctttattccaatttttcaacagcaaatgaaattgcggttttttggtactgtaaattttaaatataacagtatttgatgtttcgtcatttagcgggtgtgtgccgcaaagtattcaaaacatcggcttgaggatttataataaggtatatcaatcaatgcagggggagttatgtatgaagtgcaaaaaaatgaacagggtacaattaaaagagggaagcgtatcaatggccctataaactgcgtctgccctcattaatggagggaaatttgtgaatacgccttattcacagtcagctttacggcacaaccaagtgttcatttggctttgtgttttgtcatttttcagcgtattaaatgaaatggttttgaacgtctcgttacctgatatcgccaacgattttcataaactgccagcgagtgcaaactgggtgaacacggcttttatgttaacattttccatcggaactgctctgtatgggaagttatcagatcagctgggcatcaaaaaactgctcctatttggaattatggtaaatggcttcggatcgatcattggatttgtcggacactctttctttcctgtactcattctggcccgatttattcaaggggctggtgcagccgcattcccggctcttgtgatggttgcagtagtacgctatattccgaaagaaaacaggggtaaagcatttggtctgatcgggtcgctggtggcaatgggggaaggtgtcggaccagctatcggcggaatgatcgctcattatattcactggtcatatttgctgcttattccgacagcaacagttatcaccgttccattcctgatgaaactgctggaaaaggaagaaagaatcagcgggcgctttgatatgacggggattatattaatgtctgcaggcaccgtattttttctgctgtttacaacgtcatatagaatgtcttttctgatcatcagtattctggctttcctgatatttgtgaaacatattaggaaaactcaagatccctttgttgaccctgcactggggaaaaatgttttgtttatgacgggcgtccttagcggaggcctgatattcggcactgctgcaggatttgtgtctatggttccttatatgatgaaagatgttcaccatttaagtactgcggcaattggaagcgggattatgttccccgggacgatgagcgtcatcatcttcggttacattggaggattgcttgttgatcggaaaggttctttgtgtgtgctgaccattgggattgtattgatgtcttccagctttttaatcgctgcctttttcatagatgcggcaccttggcttatgaccgtcataatcgtttttgtgtttggggggctctccttcacaaaaacggttatatctacaattgtgtctggcagtttgaaacaaaaggaagccggcgccggaatgagtctgcttaattttacgagctttttatcagagggaacgggtatttcgattgcaggcggtttattatcgatcagcttgctgaatcaaaggctgctgcctgttaacgatgatcattccgcttatttgtacagtaatatgctcattctttttacaggaatcgttgttatgagctggctggtaaccatgaatgtctataaacgttcgcgaagaaatgactaaaaagggaaaaggatcaaacttgataaaagttttgatcctttttttaaggagcttccttattacggaaccttttgccgatcaatgaaaggggcgttaaagtgaattacatttataagaaaaaggaaaagaaaaatggaaaattgtatcatttcaatcagagataaatgggagaatgcacttattgagtctgaacaaaaaaataatcgtaatcaattaccgtaacgagaaaacaaccaagttttcactgccaatcgagacttttgaaaaagtgtatgaggatattaaaataggccggagagaaagttaatcactgtttgaaaatgactatgaagttcgtaagcggtatggttttaaccgcatctggattcccctggcaaagtaaaggtctttagggatttatgtcaaaataatagtaagtaccttatgcaacagggagtttggttgcttcataaggaggggaagtatgaaaaataagattcacatattgggagcctctggtgtcggaacgtcaacattgggtgttgcattatcaaagcatttgccgcatacgcatcttgatactgatgattactattggacagataaattcactaaaaaaagagaaatcgctgaaagaagaaagttacttaaaaaagacttgacaataaatgagaaatggattctttctggcgcagtgtgccgctggggcgatgatctaaaaagttattttgaccttgtcatcttcttatggattccgcaggatatacggcttgagagattaaggcatagggaatttcagcgttatggaaacgaagtgttagccggcggcagtaaatatgaacaatcaaaaacatttttagagtgggcttctttatatgatcattccggaatggaagttagaagcaaagctttacacgaacattggatgtcggatttatcttgtccattgttaaaaattgaaggagattactcagtcaatgaaagagttgatcgtgtcttggattatctgaattctaattaaactaacggatggagataactgcaaaatccaaaagtcaaagacagttccggccattttaacggagctgttttttataccgccttcagtttgtctgttgtgaagtgatttattctcggaaagaagcagcggaattaatagagaactcacttcgggaaaccgtgaaggcaggaatcaaaacgggagacttggcggtcaatcatcaacgtcagactttgcagaagaattgcagaaatgatcggatgttaaggcggaaaataagaagtgagaagcagatcatcaaaacgcaatacacctcaatttatattttcagtaagatcggctctgctcattaaaaaactcaattcgaagattagcggcatcaatattgccgcagatggggttagtgacataaagaggaagggataagaccccttccttaaaacctttaattcctctaatttcattgtcagatatattccttttttgaaatgggtatccaaatttcacttttaaaagatggcgatgttacatccttatgctcgttccacaggatttctgggccttcaatttgttcataatgtgacgatggaaaccattcggaataaatccgcccccatacttcctgcagtgcatccggaaatgatccggctgcttcgaatacagcccatgttgaggcagggacttcaagctgtgataggtgatttgggcaatgtttcgttgtggctgcgccaatatagtgatcaagctctccgttttcctctgtcctgccttcagaaaagttcgtggatgcactgatgagtcctgcaggcgctgtattagaaagctcttttagttgtttgattgctgcttcatctaaactttcccacatcgatgcaatgtcaggattcacgcctttgaacaaaatagggactctttttttaatgccgacgatgcgaaatgcctctttttcttcaatgcgatagttcatttcatttcctcctttgattgataactggaaggtcattcgcggataagctttaagtgaatggccattatgtttaacttctgatgggtttatgccatgcagattttgaaatgctcgtgcaaaagaatctggtgagtgataaccgtattttattgcaagatcaatcacctttacgcggctgtctttaagttcaaaagctgcaagagtaagacgtctgcggcgaatatattccgataatgaaatacctgtaaggaaggaaaacatccttttaaaatgatattcagagcagaaagcaagccttgctgcttctttgaaatcaatagcgttcgtgaggttttcttcaatatacgttaatgcgctgttcatccttttaagcgaatccatttatttgacctcctttaacaaaagaataacaggagcgaaatgtatctgcccgacatttcgtgcacagttttgcaggataacttatatgtaataaattaagttactcacctgtatttgtacagataaagaaaacacctaataactgcttgggtttcataagatgaaagaaagttatcattgttttatattgaaaagaaaatagaaaaagacggagttttcttgcgggaggggtttactatcaatcaattgaaagctgcatacgcggaggcagttaaaaaattttagttgatgtcgagaacgatgttcatcttcactgcttgttcaattagaggaagtgattcttccttaagggagatcactttttttattcgactaaagcagcagtttagcggaagaaggagaaaaatcagttgacttacttgaatactgaataggtgtaaaaagtggttattcatacggattgaaaaagaagaacacgcagcagactcacttgctcttgtttggggcaagtgttgacaaccctattagctggtttaattaaagaaggggtataaaacctgtatcaatgatgttactagatatctgcgacacaggttttatatttagctaaaatattcttatatattccacattgcatttttttattatgcaatagttcactctatttctgctttcaatttttcgaaccactctaaattaaccaagtgatgtgaacgggaattttcattcatacggcgaaagtaattgattgtgccgggaatttcttgagtgatggacaggtattcatcaaggagctcgattcgagttttagtctgatcgatttgtgattggatcagttccagtaatttatttttgtcgaattcatcggcaaagagtaacgccccataaaattgcaggttcacatattccgatttggtgccgtatttgatcattaatttttcaaattctgcccttcccgaatctgtgactttaaagttacggatttcacgcccgctggttgagggtttctgctgaatctgttcaatcaaacacttttcttcaagttgctgcagattgtaataaaatgaacctttcgtgaagttaacaatgtatttgtaatgacgtttttccattaaggccagaagttcatagccgtgagctccggggttttggatgagcaagccaaggataagtaagggaatcatggtttcatcaccttctccatccgcgcctcaaattccgcgtacgtgattttacccgaagccaaatccatactatgaaggtaaatctgttctgttttagaatagtcacccttcactttcagtgattgctcctctcccgaaatgggtttcaggatatggtgctttttcgagaaagcctcgaaatagcggtaaccgaatttgcgttgtgaagctgcgtctaaatgaatgccatcaggattcgcagtcaaacctgcagcagtaacaaaataacaattctgttgttcattagcaaaacgcagcaattgttcattaacctgtcgaaattcagtcgcgtgctgtccaaaaccggtcttcccaagaaagtcaccaagccctccaataatcaacggtacatcatcaagtttcaactcgtttcttagcgtctcaatgataagagttaatttctcgtaataagtttcatgcagcgaacgataactgtcactctcaccttggtgccaaaggattccgcaaatttgactggaacggagggcgaagcgggcttcggacaaagcatgctgaaaaaggatgccttccggatgccagtcattcaatgaactgccgccttccgcacaagggatcaagccaatttcttcatcgggatgagctttcgaccaagcatctgcaaaagatgccgccaagccaacgccggaaaccggacggtcgtaattaatcggctctgtcatcatctgccactgtccattgcgcagcatttttattttttcattatagatagggtctacttcattcaaaaatccacggcccgccatattcgactgccccaacattaaaaaagactttatcatttaatttttcacttctttacatcaatattttagtctaattagactatagtcaattcagcttgtcttgtaaagttctaataaggttttacttttattagtagtatgtatgaaaagcaaactaacattgaaaatttggtggatgtatttgagaaatagcaagttcttttgctttagatcttgataaacaatgaaaaacaacaaaaatcctgtcatgtaagggttcctatgaggttcaaaatcattaaaaaggttaacgattgtaccaattctattcatttgttatgttttacttttaaatcctgaagttatacttgaagaggaatgtcctaaaatgcagaaaaagccgggatgtcagatccggcttttcgctcactttcctttcttcttccgcttctccttttccgcccggtaaaactcatgaaacatcttcatcaatgcgcgtttttcaatccgcgacacgtaactccttgaaatgccgagctcctttgcgatctcgcgctgcgttttttctttttttagatcaagcccgaagcggccgacgatgacttctttttcgcggtcgtctaaaatatcgatatattttttgaccttttcaagttccatgttgagctgaatggtgtcgatcacatcctcgctttccgacttgaggacatcgatcaggcttatttcattcccttctttatcctggccgatcggatcatgaagggagacgtcttttttcgtttttttcaatgcgcgcagatgcattaaaatctcattttcaatacatcgtgcggcatatgtggcaagcttcgtgccttttccggctgagtagctttcaattcctttgatcagcccgattgtaccgatggagatcagatcttctgcgtcctctcccgtattttcgaattttttcacaatatgggcgactaaacggagattgtgttcgatcagcatgttgcgggcatgttcatcgccttcagccataaggtctaagtattttttctcctcactatttgagagcggttgtggaaaggcattatttttcacgtatgatactaaaaacacgagttctttcacaataaacccgagcgctgcaaaaacacctgtcaccatcctcacctccacaaagttatgtaggcaaaagcctatatgtaactgtatgtggcagtcaggctgtttgtgtctgtacagggaaattaatcaaaggcaggttttatttcttacagcctcttgatttttgctgattgagcctgtatattgttaaaaaaagtaagggtgaaaagaatataacgaaaagcgctgaagagacgagtagacagatatcattcatgacagagagctccgggagctgtgaaggagtatgaatggatgtgttgaaacaaacctcttagcttcgcatcggaatcatgaaaaacgaggatgatgcggcggatactcctgttaccgagtaagttttgtacccggcaagaggccggcaccaaaccgaattgaggtggcatagcgggctgtttcccgtcctcaagactttattgtcttgagggcgttttttatttctaagggagggataagatgaaaaacctgaagtcttggcggtacccgatgcttctgttaaccggaatcgggatagcaaatattggtgaatggatttattttttgtctcttaatcttattgttttaaaagaaacggggtctgcttttgcggtttccatcctttatttaatcaggcctgcggctgttttgatgacaaatgggtgggcgggcagcatcatcgacaggtgtaacaaacggaatatgatgatgtcgcttgatttcatccgggctgcattcattgccgttctgccgctgatgtttactgtaaggtctttgttttccatttattgtatcgtgtttttgattcaaatggccaatgcgatgtttcgtccgtgttccatggcgtatgtgacgatgcttattccggctgaaaggagaaaacgattcaattcactaagggctttgtcggaatcaggggcttttctcctcgggccggctgcggccgggctgctttttatcgccggcacgccgatttttgcgatttgggtgaatgcggcggctttagtgctgtccggtttcatcacgatgatgctgccgagccttgaaaatgagcctcacgtacattctcccagacagaagctttctttggcagtgtgcaaagaagattggaagctcgtctatcgcttcagccgaacggcgcgaaacgtcatgatcatttattttttattcagtctggtcatgaccgttatgccatccgcgcttgattcgcttgaagccgctttttcaaaagaagttcttcagctgactgatgccgattacggttttcttgtcagtgtctcaggggcaggcattattgcgggggcgcttgtcaatgtaatctttaataaaaaaatgccggcttctttattgatgggaatgggctctttattcacagcggccggatatatgatttatgcgttttctgacgttttttggacggctgctttcggatttttccttctcgctttttttctggcgtttgccaatacaggctttctgacgttttatcaaaagaatgttccggtggacatcatggggagagtggggagcttttattcattagtcgaagccgtcttcattatattggtaacggcggttttcggagcggcggctgtcggttcttccgtccgcgtcatcgtcatcgcaggggctgctgttatgctggcgttggcagccgttttatgctcgttcttatttgcggcctcaaaaaggaggactcccgatgtgtttcaagcggatcaatttaaagaaacataaagagacggccgtttcatttcgtgaggatgagtatctcaggtggctgtcatcccaaatctaatgctcacccgacaattttaagctgcttcttcataacgggcagccgatcggacagcttgaagcttccatcaacttttaccgcagccaaaaaatcggttatgtgcacctttactgagcagcaaagagaacgcggaacgaagctgcatcaatttagaattaaacggaaaagttctcagaatgagaggagccgtaccgccggaataggaggcggtacgcgcttcattttttcgttgtttttaaaagaccgggaaacttcttataaatgaccgccattaagacgagcatatacattccgtaaatcccgaaagacagcagtttgttgcttgtaaatgaagcgcctgcgacggtcacgatcacaatgttcggaattttgccgagcaccgacgcagaaaaaaagatcggccatcgtatgttactcagcccgcagacggtattcatggcaagcgacggtataatcggaatcagccgcccgaaaagcaccgccgtaaacgcgtgctgatgaaatgaaccttcatattgagccgcggccgggtaagccaccagtttttttctggcccagtctctgaatccgtaccggacgagaaaaaacaatgccattgttccgagcattgcgcctgacaatgtaatccacactccgtttacaatcccgaaaaccgctccgtttaaggccgcgataatggcgaatggaacgatcggaaaaaatacgtcagctgcgaccagaaggatactcataagcacggcatacatgccgcccgcgcgaatcatgctgagccagacgtctttttgcataaagccgatcatcacgacagcaatgatgacggcaagactgaatcccttttttatcatctgtacgttcacctcttttcaattagtatacagcacaaatctatctccttctattaaaataagctgtccgataagcgtacttgtttatcagcatttgccgtttgatgagaaacggctggcagccgggtttggacaaaaacatgcgggaagcgggtgatgtgcatcatttgatgcagagaatgattttatacaaaaggggacacgttaacagtagtgtttactggaggtgtaaacgttgagatgctttcatctgatcatcatgatatgcgtcctcacgggtctcactgccgtgtccgccgatgcgaaatctttaaaaagaagtgacatggagaagacgggaaacgtgtactgggatataaggtctgaaaaaaagaagctatctttaaccttcgatgacggcccccatcctgtctatacggaggctgtgttagacgtgctgaaacagcacaatgttaaagcaacctttttttgtatcgggagccgtatagacaaataccccgtaacggcaaaacgcatcgttgaagaagggcatgaaatcggcaaccatacgatgaaccatgtttattttcaccgtttaaaacgcaaagacattttacaagagcttcacagctccgcgcatcatatcagatcgctgcagccggaaggggacaagttattccgcccgccgggagggtcgctgaatcatacggctttcaaaagcctcttaaaagagggctatcatatcatcatgtggtcatggaaccaagatccgagggactggaaaaggcccggaaaaggaaaaatcgtcaggcacgttgtttcacatgccagagatggagatatcgttcttctgcatgacggcggaggaaaccggcgccagacggttgaggctttgaaagaaatcattccccagctgaaaaagcagggctacacgtttgttaaggtttcggatttgatcggacaggattccggtccttttcatatccagtaaagagagcgccgcgttgaaagccgccaaagagatgtgtaccataggaggtaaggtttggggggagagaaaatgaagtttgctgttctttttattacgataacctgtctgttatcaggatgcgctgcgggcaaagagaaaagtgttgtcgcgttcggcgacagcaatacgcgcggttccaactgggattatcgtgattatccgaaggcgcagcagtgggtaaacattttaaaaacagcggaacgcggccgtcttacggttataaatgcgggaataggcggccagacgactgaggatgcgcgcctgcgctttcaaagcgacgtgctggagcgtaagccccaatatttatttatcatgttcggaacaaatgatgcgggcattttgacgggagatcagccgcgagtatcaaagaaacggtttaaagaaaacctgacttatttcataaacgaaagcagaaatcacggcataaagccgattttaatgacgtgcatcccggttatagaaggaaacggaacgcatcatctctattactattcgagatataaagcctcagcctttaaagaaaaaggcggcgcgagaacatggcataattcctataacggcgttacgaggcaggttgcagctgagttgaaagtgccgctggtggataactggaaacactttatacgcgcggacggcggcaaagatacagaccgggcgctgatccaatccggactgatagatccctccggaaatcatatgacgccaaaaggcgccagaatcttaattgaaggcataaaaaatgggcgggttttggaacgctgacgccgtcagctgcctaaaccgttttgcttctgcttcataggctgtagaaaaaacatcttttggaggcgattgctatgaaccgcggtttccctccgcaatatcctgtatgcccgcctcctcgggtgaatgcggggtactggtacgcattttttgttgtgctgctcgtcgtcattctcgttctgggcggtctgtattggttcaatatatagcagccgtcctcttaaacacctctattttaggggtgttttttgttgaaagtggtagtaatgcgcataaccgaagtgatataatatcagtcatctgagtaaaaaaaggaaattcgcccgggaattttttctgtttaagaagaaacggaaataatgtgtccgagcgatcttcttttgatttcgttttcaattaactcgataaattcacggctcaaattcatttcattggctttgaaataagattctattagtaattcatcagaaagctttctcatgccggggacccaattaatgggagtggcacctccttacaattgtaatcaatcatcagacgcaagcatatgatggaaggttgcgtttcaatcatggtgaggttatctttaatctaccatgaaatacaaataagaacaatcgttctgttatccacactcgtaagtggataacttgttagtatcttgtttataatctggataaatccggatgtaataagagtggataatgtgtgtaattttatccacaactggtgaagaaacccaatttttgtcgaaatttttttaccgagtccgactttgtttttaaatctgacagatttcgacatatagatgatagaaagaaaaggaagggtgcgggttttgttaaaaaagttttttttacctgacgaatttgtgaaaaatatatttcatatcacaccggaaaagctcaaggaacgcaatgtgaaagggattattacagaccttgacaacacgcttgtggagtgggacagaccgagtgcgacacctcgattaatcgagtggtttgaagaaatgaaggagcacggcattaaagtcacgatcgtctccaataataatgaacgaagagtgaaattattctcggagccgcttggcataccgtttatttataaggcaagaaaaccgatggggcgcgcctttaaaagagctgtcagcagcatggagctgaaaaaagaagactgtgtggtcatcggcgatcagctgcttactgatgttctcggcggaaacagaaacgggtatcatacgatcctcgtcgtgcctgtcgcttcctctgacggagtcatgacgcgctttaaccgccggattgaacggagaatattgagttctttgaaacgtaaaggccatattcagtgggaggattaggaatggaaaaggttgtttgcatcggctgcggagtaacgatccagaccgaggataaacaaggtctcggatacgcgccaaaggcatcgctcacgaaggagaatgtcatttgtcagcgctgcttcagactgaaaaattacaatgaaattcaagatgtttcattaacggatgatgactttttaaatatcttgcacacaatcggcgatactgactctctaattgtcaaagtcgttgatatttttgattttaacggaagctggataaatgggctgaaccgctttgtcggcggtaatccgatcattcttgtcggtaataaggccgatatcctgccgaaatccgtaaagcgggaacggctcgtccaatggatgaaacgcgaagcgaaagaatacggcttaaaaccccttgatgtctttttaatcagcgcttcccgcggacaagggatgaaggaagtcattgacgccattgaacattaccgcgaagggcgggatgtgtatgtggtggggtgtaccaatgtcggcaaatccacatttatcaaccggattattaaagaggtctcaggggaagagaatattattaccacctctcaatttccgggcacgacgcttgatgcgattgaaatcccgcttgatgacggatctgcgctttatgatacgccgggaatcattaaccatcaccagatggcgcattacgtggacaagcgtgacttaaaggtgctgacaccgaaaaaagaactgaagccgcgcacttttcagctgaatgaaaaacaaacgctttatttcggcgggcttgcccggtttgactatgtatcaggcgataaaacggcgtttgtctgctatatgccgaatgaattgatgattcacagaacaaagcttgaaaatgctgatgccttatacgaaaagcatgcgggagaactgcttaccccgcccggaaaagatcatttggatgaatttccggagcttacggcccacacgtttacgattaaagaaggaaagacggatatcgttttttccggactcggctgggtcacggtgcagcaagcagataaaaaaataacggcatacgctccgaaaggcgtacacgtatttgtccgccgttcattaatatagagagaaggggagagggagcatgaaacaattgtacggagtaatcggaaatccgatcgggcattcaatgtcacccgatattcataacgcggctttgcaagataagaacatcaacgggcagtattttgcgtttcaggtggaacctcattatctcaaggacgccgttaacggaatcaaggcgcttggcatctgcggagtgaacgtcacagtcccgcataaagtcgcgatcatggagcatctggatgaaatacatgaaagcgcgaaagtactcggggccgtaaataccgtcaaaagagagggagacaggctcatcgggtataatactgacggagatgggttttataaatccttagtcaaagtattggacaaaccgatatcagagctctccatcctcatgattggggcgggaggggcggcaagagcgatttttacgacgatcgtccgcagagagccgaaacaatttgacgtttgcaaccgcacgccggaaaaagcggaaagtctgattgcggctgctccctcttttcagcagaaacgcgcccttactttaaaagaagctgaaaatcagcttgaacaatatgacgtcattattcatacaacatctgtcggcatgtatccgaaaacggatgccgtgccgctctcattggaacgggccaaaacgggcgccatcgtttgtgatatcgtatacaacccgattcaaacggcgttcttaaaagaagctgaaaaaagaggtttaacaacccttgacggtgtcggcatgtttgtggaacaggctgcactgtctttcaagctgtggacggaacaagagcctgacagcggcttaatgagagcaattgttgaaggaaaactaggaggaacacaatgttaacaggaaaacaaaaacggtttttgcgttcaaaagcgcatcatttaacgcctatttttcaagtgggaaaaggcggagtcaacgaaaacatggtgaaacagattgcagaggctttagaagcaagagagctgattaaagtcagcgtgcttcaaaactgcgaagacgataaaaacgatgtcgcagaagcgcttgtgaaaggcagccgctcacaattggtgcagacgatcggaaatacgatcgtattgtataaggaatcaaaggaaaataaacaaatcgagcttccgtaaggtggttgacatgaagaaaatcggaatattcgggggcacatttgaccctccgcacaacggacatcttctgatggctaatgaagtccttcatcaggcggagctcgatgagatttggtttatgcccaataaaatcccgccgcataagcagaatgaagactttacagacagccggcaccgggtggagatgctgaagcttgccatcagctctaattccttctttaagcttgagcttgcggaaatggaccggaaaggcccttcttatacctatgataccgtccgtttactgaaggagcggcacccgaacgacaagcttttctttattatcggggcggatatgattgaatatctgccgaaatggtacaaactggacgaactgctcacgctcattcaatttatcggagtgcggcgcccagggtatcatatcgagaccccgtacccgctgctttttgccgacgttccggaatttgacgtttcgtcaacgatgcttagagaacgtctcaaagcaaaaaagccgacgcaatacttaatgccggataaagtgaggcagtatatagaggagaatgatttatatgaatcgtgaggaagcacttgcctgcgtcaaagaacagctgaccgagcatcgctacatccacacaatcggcgtgacagatacggcggttattctcgcaggccggttcggagcagatccgaaaaaagcggaaatggcggctatttttcatgattatgcgaaattccggccgaaagaagaaatgaagcagatcatcgtgcgggaaaaaatgcctgctgagctcttggattacaatgccgagctgtggcatgcccctgtgggagcgtatttggctgagaaagaagcggggatcactgatcccgaggtcttggatgcaatccgctatcacacgtcagggcgtcccggaatgacccttttagacaaagtcatctacgttgcggattacattgaacccggccgccattttcccggagtggaagaggtgcgccgtctggcggaaacagatctgaacgaagcgctcatacaagcgatgaaaaatacaatgatatttctgatgaaaaaaaaccagccggtctttccggagacgtttgcaacctataactggctggtgtctcaaaaacgacaggaggaatatggaaaatgaatcaagcttccgtattaaaaatcgcggcaaaagcatgcgacgataaacgtgcagaagatattttagcgctggacatggaaggaatctcacttgtagcggattactttttaatctgccacgggaattctgataaacaggttcaggccattgcgcgcgaaattaaagatcaggcagaagaaaacggcattgatgtcaaaaagatggaagggtttgatgaggcccgctgggttttagttgatctcggcgacgtcattgtccacgttttccataaagatgaaagaagctactataatcttgaaaagctatggggcgacgcgccgctcgcagagcttgaactcggcttgaactcatgatttaccaaggcttcgccggtgtatatgacgagttaatgtcccatgcgccgtatgatgaatgggcgggctggatcgaagcgtctcttccggaaaagggaagggtgcttgatcttgcctgcggaaccggagaaatatccatcaggcttgctgaaaaaggctgcgaagtcacggggattgatttgagtgaagatatgctgagctgtgcccagcagaaaaaaacaggaaagccgattctttttctccagcaggatatgagagagctttccggttttgaagaacagtttgatgccgtagtcatctgctgtgattccctaaattacttaaaaacgaaaaatgatgtcttaagcaccttcaaaagtgtttttcaagttttgaaggagggcggcctgcttctgtttgacgtccattccccgtataaaatgacggagctttttccggacagcacccatgcggatcaggatgagcagatcagctatatctggcaaagctttgccggcgatgaagagctttctgtcatccatgatatgtcctttttcgtatggaacggacaatcttatgaccgctatgacgagacgcatgagcaaaaaacattttacattgaagaatataaacaaatgcttgcagagaccggatttgaattgaagaaagtgacggctgattttacagaccggcctccttcaacagagtctgaacgtcttttctttacggcaggcaaaccaaaaaccatcgtttaaacggaacgatggtttttaaaatgcattttttgcgattggcgtgataaagctctttatggcatactcagttacacgtgaaattgcttcttcactaacgatatatcttcatcgtatttgtcatgtgtacgctgaaagacacgattgaacatatcctgaacaccgctttcgagagccttcagtccttctccggtgacgccgccttttacgcatactttttcctgcaaggcgggaagcgtgtaatgccccgtttcaagaagctttccgagaccgacaagcatttctgtcgacataatcacggcttcttctttggtgatgtccgtttcttccactgccgcgtcaataaagcgctgaacgagataactcataaaagcgggcccgcagctgacaatgtctgacgccgctcttgtaataccgctgctgatttccacaggttttgaaatatgagtgaacagcgtttgaatatccgcttttgcagactcgctgcagcttttgccgaacgtaacaagcgagacgccggccaaggcgcggttcgtaatgctcggaatgacgcgggccgtctgacacggaaccgtatgttcaatctgatccgtctgaacggggctggtaatggagattaaaatgtgatctttccgtaaatgcggtgtgagttttttcagcaaaggatatatatccagcggttttacacaaatgaatatgatttcattatcctgtacgagcttttcctgatcctcggtgacgtggatgccgctgaaacgttcttttagttttaatgctttttcgattgttctgtttgtgatggtgatatgtgagggatcggcagcgtttgattcgataaacgattcaatcaggatcgttcccatgtttccggtgccgataaagcctattttcaatgaattcccctcctttttcccttaatcctctaaaccttatgcggggaggcaatgcaatatgacgaaagcgatgatgacggagcggatgcggcggaacctgaaaattctgggcgcttgtcttgcggcaggtgcggtttttatctgtatttggctgtttcgttctgaaaaggaagagccggtcaaacagcagtccgtgctcggtcaaacagcctccgcatccgtcgcggacaaaaaagacaccgcagacgataagattatgattgatgtgaaaggagcggtccgaaatcccggcgtgtatgaaatgaaagcgggagacagagtgacgcaagccattgaaaaagccggcggcctgaagaaaaaggcggatgaattgaatgttaatttagcagagcagctgcaggacgggacgattgtttatattccgagtgaaggcgaagaggagaatcgcccgaaaacagcagttggtgaaaaggagaatgcagctgtcaatatcaatacggcatctctggacgaacttcaggcgatttccggggtggggcagaaaaaagcggaagctattatcgcctaccgagaagaaaacggacggtttcagactgctgaagatttgatgaatgtatcaggctttggagaaaagtcatttgagcggataaaaacttccattacggtaaagtgaattgacggttctgcttaaatctatgtaaacttagaaaagcaacaagactttttggagggaacacttgtggaacgaatctcatggaatcaatattttatggcgcaaagccatttgctggcgctgagaagcacatgtccgagactgtcagtcggggcaaccgtagtcagagataagcggatgattgctggcggatacaacggctcaatcgccggcggcgtccattgcgctgatgaaggatgccttttaatagataatcattgccagaggaccatacatgcagagatgaatgcgattctgcaatgttctaagttcggtgttccgacggagggcgcggaaatttatgtgacgcattatccttgtattcaatgctgcaaatcaattatccaggcaggcatcaaaacggtctattatgccgaagattacaaaacacagccttatgcaaaagagctgttcagccaagccggagtcaaggtggagcaggtcgaacttgatgaaatgatcatcgatctgaaaaaccgcgaaaaattgtcttttgtcgcaggtctgattcagcaattatctgatgcgggagttaaggcagatgaactgaaaaaaattcatgaacaggccaatgagctgtttaccagttacgtataaatgaaatataaataccttcttctgcctctggcggcggtttctgcaactgcggggattgccgccgctcatgtcttctgggttctgctcctttttcttctgtatcttctctttattatgataaaaacaaagcagcctgctccggttatcatctgcctcgtttctttttgtgtttatttctttctttatacggtttgtgacgctgtgaatgtaacgcggtatcaggccggcagttatactgaacaggccgtcatcactaatattccgaaggttgacggagcgaaaatgtcagccgttatccgtacacatgacaaggaaaaatgggcggcttcgtacaaaatccggtctcttgaagaaaagagacgcattgaacagcttgaaccggggatgcgctgcacatttacaggctctctggaacagcctgcacatgcgacgattcccgggggttttgattataaggaatatctttactctcagcagattcactggttatttaccgtgacttccattcagcagtgtgaaaaatccaaacagccgctgtttaaactgctgagcatcagaaaaaatttgatttcgatcattcggaatcacgtgcctgaatcttccgccggaattgttgaagcgctgaccttaggtgaaagattttctatagaagacgatatactgagtgcatatcaaaatttgggagtcgttcatttaatggcgatttccggaatgcatgtcggtcttataacggcgggattattttatgctctgatcagaatcgggctgacaagagaaaaggcggggatattgctgctgctgtttttaccggtgtatacgctgctgagcggtgccgccccatccgtattgcgcgcatccctcatgctgggattttatatcgccggaactcttgttaaacgcggcattcattcctctgctgcattgtctctgtcttatctgctgctcctgctgtttaatccttacctcctttggcaggcgggcttccagctttcctttgcggtaagcgcctctttaattctgtcatcctccattttaaagaaagcagggaaaagcagacttgccgggcttgcgatggcttcattcattgcagagctcagctcacttccgtttcttctctatcattttcagcaaatttcacttgccagttttccgatgaatatggtgatggtgccattttatacgttatttgtcattccggtttctgtcatcggtttccttcttcttttactttcaaggcagatgggagaatgtttgtttaatatgtttgaccttgtgatgaagcctgtgcatgatttcattacatatgcggcatccgttgatttatttactatgattgtgttaaagcctgactttctttcccttcttctgcttgcggtttccgtttttacgctttttgcggctttagaaaagggaggttttttaaaactcaggaaatcggctctttttttctgcgcggttttggcttatttaatatgccgtccgtatttcagcccatggggagaagcggatatgcttgatatcgggcagggagactcgctgtttataaacgcgccgcaccgcaaagggaccgtaatggttgatacagggggagtgattgcttatcccggagaatcatggaaagaaaaacgccacccgtattctatcggcgagaaggttttgattccgtttttaaacggaaaaggggtgaaaaagctggatgcgctgattttaacccatgcggatcaggatcacatcggggaagccggagtgttaatcaaaaatcatagagtcaaacggttaattgtccccgtgggattcgtaaaagaaccgaaggatcagaacatattaaatatggcgaaagaaaacaacattcccgttgccgaagcaaagcggggcgacaccattacagccggtgatcttcagtttcaggtgctgtctccggagtcgtctgacggaaagagtaaaaatgattcgtcactggtgctttggacggttttaggcggagtgagctggcttttgacgggagatttagaatcggacggcgaaacagaagtgctgaaaacgtatccgaaactgaaggctgatatattgaaggcgggtcatcacggcagcaaaagctcaacgagtgaagcctttttgaaacagcttcagccggaagcagcgctgatttcagcaggaaaagagaatcgataccatcatccgcacgaagaagtgctggatcgtttgaaggcgtactctgtcaatgtgcttcgcaccgatatcagcggaacgattcaatacagatttgaaaaaggcgccggaacgttttccgtcttccctccatatgatatagaagaaaccagggcgcaagaagtaaaaaagactgccgattgacagcagcccggaatgcggctaagagccgataagatggatggctgttgccatcacgaacaaaaaggcgaaaaatccgaaggacacgacaaaaccgacagctgagtcaacagcatcatttcgtttgctttgaacgtttttttcaaaatcattcaatttcatccctcctgacttccctaagtatactggaattgttttgaaaaatctagaagtgatggtaacgttttctgttcttgtgattatcgcctttttacaagcagacccgggagcttgtgaatcaggcgtttattataaatgaggaagctgtcctttttaaagcttcctctttactatttgccgaactcaatttaggatagaaggggatcaagaaagagaggaagtcatacgatcatggtatttgatgtttggaaagccctgaaaaaaggggatgtccgctccgtttattgcttatacggaaaagaaacgtatctgctccaagagactgtcagccggatcagacaagctgtcgttgatgaggagactaaagattttaacctgtctgtttttgatcttgaagaggatccgcttgaccaggccataaccgatgcggaaacgtttccgtttatgggagagaagcggctggttatcgtaaaaaatccgtcttttttaacaggggaaaaaaagaaagaaaaaatagagcataatacaagcgctttggagacttacctgaaggagcctgcgccttatacggtctttgtgattgtggctccgtatgaaaagctggacgaacggaaaaagctgacgaaagcgctgaagcaaaaagcccttatgattgaagctaaggagctgaatgcaaaggagacgactgattttacgattaatctggcgaaatccgaaaataaaacgatggatacagaagctgccgagcatttggttctgcttgcaaacggccatctgtcttccatatatcaggaaatacaaaaactctccgcctacaccggtgacagacatgagatcacgcttgaagatgtccgggagcttgtcgcaagaagtttggagcagaatatttttgagctgatcaacaaaatcgtgaaccgaaaacggacggaaagtcttcaaatattttatgatcttttaaaacaaaacgaagaaccgatcaaaattatggcgctgatcgccaaccaattccgtctgattatgcagacaaagtattttgcgggacaaggatacggccaaaagcaaatcgcttccaacttaaaggtgcaccccttccgggtaaagctggcgatggatcaggcgaggctattttctgaagaagagctgcggcgtattatagaaaggctcgcagtaatggattatgaaatgaaaacggggaaaaaggacaagcagctcttgctggagctctttctccttgagcttctccggactgaatgaaaaaaacgatccccgttaaagggatcgtttttgtattatgcagaaagtccgttcacttgtttcgcaagtctagatttgtatcgagctgcggcatttttgtgtacaagacctgttttcactgctttatcaatgcgtttcgctgcttcagaaagagcagttttcgctttatccgcttcgttgttagcaacagaagcttcaacttgtttgattgcagtacgcatagcagatttgattgtcgcgttatgagcgcggcgttcgttgtttgtttttgtacgtttaatcgctgatttaatgtttggcatgtgtttcacctcctaagatacaacctgtagcacagtgtcttaaggttaaatcttcttcacaatagaacaaattgtattctatcaaacagaactttagattgcaatataaatgtaaagtatttttcgttgatgggtaaattcgcatgattcgttttgtaaatggccacactatgtaccacgatgattgaaggaggtctttcctgtgaaaaacaacgaactggatgtcaatcaatttctgatacggacggatttagcggtagaaacgaaacaggcggtaaaagacggacaagccggtcagacaaaagaaataaacgggtttattgaaaaagaacgcgacaagggcggcattaaagtcagaaccgtcgatattaccaaagaaggcgccgagctatcggggaaaaagcagggacgctatgtcacgatcgaggctcaaggggttcgggaacacgactctgacatgcaggaaaaagtaacggaagtgtttgccgaggaattttccgcctatctgtcggcattaaagattccaaaggatgcaagctgtttgatcgtcggtctcggcaactggaatgtgacgccggatgcgctcggccctctcgtgaccgaaaaccttcttgtgacaaggcatctgttcaggcttcagccggaaaacgtgcaggaagggtacaggccggtcagcgcgcttgctcccggtgtgatgggattaacgggaattgaaacgagcgatattattcaaggtgtgatcaaagaatcaaagccggattttgtgattgcggtagatgctcttgcggcaagagccgttgaaagggtgaacacgaccatccaattttctgatacgggcattcacccgggatcaggcgtcggcaataaaagaaaagaattaagcaaggaaacgctcggcatccccgtcatcgcaatcggggtaccgactgtcgttgatgcggttacgatcgcgagcgatacggtggattatatattaaagcatttcggcagagagatgaaagatgacagcccgtcaagatctctggtgcccgccggaatgaacttcggcaaaaagaaggtgctgacagacgaagaccttcccggagaaaaagaacgccaatcctttctcggtattgtcggcacactggacgaaaacgaaaaacgccagctgattcacgaagtgctctctccgctcggccataatctgatggtcacaccgaaggagattgacacctttattgatgatatggcgaacgtgcttgcaaacgggttaaacaccgcccttcatgaaaaagtgtcacaagataacaaaggttcttataatcattaaaatggttctacctcctctagcttgttcatagagtaattactagacaagcgctggagggattcaaatcatgagaaaaaaacgcagaaaccgtcaaattgtcgttgcagtaaacggtggaaatgcgctcaagggcatgtttttgtttatgacaagccttatcgttattttcgtattatcgggtgtgctcacatcgcttcgccctgaactgaggctttcttcgaattctcttcacggaattgccggagaacttccgggtgacgcgtttgcacacctcctcggtatggaaaatcattatttcgcctcagagcttcctgaaaaagactcttttcagctgtcccggctttccttaaaactggcgacaagcattaatatggaagacccgcggagtttcttgggacgtgagctgccgggatttgcccaatacgatacggagatccttctggcggggcaggggactgattatacgaatatgcctgctgaatccccgccgccgtcaaaggtgatggaaaaagaaaaagaagtgaacctggcagaaatcgaaaacaaaacgaaaaaagaagaaaaggcgccgccgaaacattcaacaggcagcaaaaaagtcgtttttatttaccacactcataataccgaatcctatcttcctctgttaaaaggggaaacaaatccggataacgcccgccattcgaaggccaatgtcacgcttgtcggagatatgttcggaaaagcgcttgaagcgcaaggtgtaggagcgaccgtagataaaaccgacattcaggcccgcctgaacaaagacggtttaaattatgcgcgaagctacgacgaatcaaggccggtcgtaaaaagcgcgctcgccaaaaataaaaacctgcaatataccatagacattcaccgggattcccgccgcaagaaaaatacgacagccgacatcaaaggaaaaagctatgccagggtcgccatcgtcgtcggcaaaaaaagcgctaattttgaagaaaactataaactcgcaagtgaacttcataagctgatggagaaaaaatacccaggcttaagcgtcggtgttttatcaaaaggctctccgggagataatggagtgtacaaccaggatttaaacgatcggtcgcttctgctggaattcgggggcgtggataacaatcttgaagaactgaggcgcgcatcagatgccgtggccgatgtattcagcgaactgtactgggatgcagacaaggtcagctcgcaatcaggagagaagaaaaaacaatagaaatcaggtgatgcaaatgatccgttttaccggcaaatgcctgctgatcgccattgtcatgtttgtcggcgtattgttcggcatgcagcaggcaaacagcggaatgcttgatatgaaaggatacaaagatccctccttaaaaggagcattcacgctcggcggcggagaaggacaggaaaaagaagcttccattttggggcaaaccgttacggcgaaagatctggaagaaaaacaaaaacagctggaacaggcagaaaccttcaacctgttttcaaaagccggagaaaccctttcaaataccgtgacggactcggcacaggcgatgtatgagtgggtttcgaaactgaaccgttagcattgatgaagagaaaagcggatgattccttaaaggaagcttttctctttcttgttttaattgaatgtttacaatcctattgatataatctaagctagtgtattttgcgtttaatagtaggagtgatagattgtgacagataaagaaaagcgtttagagaggcagtcaagaatccggaatttctccatcatcgcccacatagaccacggcaaatcgaccttggcggatcggattttagaaaaaacatcggcgatcacccagcgggaaatgaaagaacaattgcttgattcaatggaccttgaacgcgaacggggaattaccatcaaattaaattccgttcagctgaaatacaaagcaaaagacggagaagaatatatattccatctcatcgacacgcccggacacgtcgactttacatatgaagtttcgcgaagcctggctgcctgtgaaggcgcgattctcgttgttgatgcggctcagggaatagaagcgcagacattggcgaacgtctatctggcgcttgataatgatcttgagattcttcctgtcattaataaaatcgatcttccgagcgcagagccagaacgtgtgcgtcaagaggttgaggacgttatcggccttgacgcttcagacgccgtcctcgcttcagcgaaagcgggcatcggcatcgaagacattttagaacagatcgtagaaaaagtgccggctcccgcgggagatccggaagctccgctgaaagcgctcatctttgactcgctttatgacgcgtaccgcggagtcgtcgcgtatatcagagtcgtagaaggaacggtcaaaccgggccagaaaattaaaatgatggcaaccggaaaagagtttgaagtcatcgaagtcggcgtcttcacgccgaaagcgcagccggctgacgaattgacagtcggtgacgtaggctatttgacagccgcaatcaaaaacgtcggcgacacccgtgtcggtgatacgatcacgagcgcggttaagcctgcggcagaagcgcttccgggctaccgcaaactcaatccgatggtatactgcggactttatccgattgacacagccaaatataatgatttgcgcgaagctctggaaaaacttgaattgaacgattcatctcttcaatacgaggcagagacgtcacaagccctcggcttcggtttccgctgcggctttttaggaatgcttcacatggaaatcattcaagagcggattgaacgggaatttaaaattgaccttattacgaccgcgccgagcgttatttatgacgtttatatgacggacggcgaaaagatcatcgtggataacccgtcaaacatgcctgacccgcagaaaatagagcgggtggaagaaccttatgtcaaagcgacgatgatggtaccgaacgattacgtcggagcggttatggagctttgtcaggggaaacggggcaactttatcgatatgcagtacttagacgccaaccgagtcagcattgtatatgagatgcctcttgcggaaatcgtatatgaattttttgatcagctgaaatccagcacgaaagggtacgcctctttcgattacgagctgatcggctacaaaccgtccaaactcgtcaaaatggacattatgctgaatgcagaaaaaattgatgcgctgtcgtttatcgtgcaccgcgattacgcatacgagcgcgggaaagtcatcgtcgaaaaattgaaagaattgatcccccgccagcaattcgaagtgcccgtgcaggcagcgatcggacagaaaatcgtggcccgctcaaccattaaggccatgcggaaaaacgtccttgcaaaatgttacggaggagacatctcgcggaaacggaagcttcttgaaaaacaaaaagaaggaaaacgccggatgaagcaggtcggctcggtagaagtgccgcaggaagcgtttatggccgttcttaaaatggatgacagcccgaaaaaataacggaagccgccgcagtcccgcgctgcggcttctttctgtaaagaagaaggtgtttcaaaatgaaatcagcttatattcatattccgttttgtgagcatatctgccactattgcgatttcaataaatattttattcagagccagcctgtcgataagtacttaaactcactcgaaaaggaaatgataaatacaatagaacggacgggacgccctgatctccgcacgattttcatcgggggaggcacgccgacatcgctctcacccgcccagctggaaaaattgatggattccattcaccgcgtgctggagccttctgacggactcgtagaatttgccgcggaagcgaatccggatgatttgtccccggaaaaattaaaaatcatgaaaaatgccggtgtcaatcggctgagcttcggtgttcaaacctttgaaggtgagcttttacaaaaaatcggcagagtgcataaacaaaaggacgtattcacttcctttgaacgtgcgagggctctcggctttgacaacatcagtctcgatttgatgttcggcctgccgggtcagacgctggccgatcttgacaattccgtcaaaacggctttgtctcttgatgcggagcactattccgtttactcgctgatcgtagagccgaaaacggtgttttataatttaatgcaaaaaggccgcctgcatctcccggcgcaagaacaagaggccgagatgtatgaaacggtcatgaggcagatgagtgaagcgggcatccgtcaatatgaaatcagcaactttgcaaagcccggatacgagtcgcagcataatctgacgtattggagcaatgaagcgtatttcggttttggcgcaggcgctcacgggtatatcagcggcacgcgcaccgtcaacgccgggcctgtgaaacattacattcagctcatcgaagaaaagggactgccttaccgtgacacgcacgaggtgacacgggaggagcagattgaagaagaaatgttcctcggtctcagaaaaatgtccggcgtacaaaagcaagcttttctcgataaattcggacgctcggtcgacgaactgtttcccgatgttctcaaagatttaaccgaaaaaggcctgatctgtgacacggaagaatcggttgcattaacgcatgagggcaaattattaggaaatgaggtttttggcgcttttttgggtgagttataattgacatttttcttttggtttgttacttttgatatagaattagcactcgctgaccttgagtgctaacaggggtgatgatgatgttaacaaatcgtcagctgttgatcctgcaagtgattattaatgattttatacaatcagcgcagcctgtaggatcaagaactctttcaaaaaaagacgagattacattcagctctgcaacgatcagaaacgagatggctgacttggaggaattgggctttattgaaaaaacccattcatcctcaggacggattccgtcggaaaaagggtacaggtattatgtcgatcatttgctgtcacccgtcaagctgacaaaaaccgatctggatttaattcactcgatatttaaagaaaaaatcttcgagctggaaaaaacagtccaaaaatcagcgcaaatcctgtccgacctgacaaactacacatcgattgtcctcgggccgacgctgagcgagaactatcttaaacagattcaaatcgttccgatccagccggataaggcggtcgccatcctcgtcacgaacacggggcatgtcgaaaaccgcaccatcaatttcccggctaaagtggatttggccgatattgaaaaactggtcaatatattaaacgatcgattagcgggcgtgccgatggacgaactgaatgagcgcatttttaaagaggttgtcacatatttaaggcagcatatcgccaactatgacagcatacttgaatcgctccgctccacattccatccggcggcccacgttgagaaattgtttttcggcggaaagatcaacatgctgaatcagccggagttccacgatattgaaagggtccgctcgctcttatctttaattgaaaaagagcaggatgttctgaagctgtttcagtcatcaaaagccgggatttcaatcaaaatcgggaaagaaaacgactacgaagaaatggaaaactgcagcttaatcacggccacctatacagttgatacgaagcagatcggatcaatcgcgattatcgggccgacgcgcatgaattattcaagagtcgtcagcctgctgcagcacgtgacttcggacttgtcaaaagcattcacaagtttgtatgatgaataagggaattttggcaatcattttcagtcatctttttacagcatttgagggaggtgaacacaatgtcagaagaaaaacaaaccgcagaacaggttgaagcagcagaacaagaagaagtgacagaacaggcagaacaagcggcttcacaagagcagcatgaagaaacggcaggtcaggaagaagcccttcagcaccaaattgatgaattgcagggtttgcttgatgaaaaagaaaacaagcttttgcgtgttcaagcagactttgaaaactataaacgacgcagccgccttgaaatggaagctgctcagaaataccgttctcaaaacgtcgtaacggaaatccttccggctctcgacaactttgaacgggcgttacaggtagaagctgaaagcgagcagacaaaaagcttgctgcaaggtatggaaatggtccgccgccagctgatggacgcacttgaaaaagaaggtgttgaagccatcgaagctgtcggtcaggaatttgatccgaaccttcaccaagccgtcatgcaggtggaggatgaaaacttcggcagcaatattgttatcgaagaactgcaaaaaggctacaaactgaaggatcgcgtcatccgtccttcaatggtaaaagtgaatcaataactacatagcaggaggtaattcaaagtgagtaaagtaatcggaattgacttgggtacgacaaactcatgtgtggcagtgcttgaaggcggagagcctacagttatcgccaacgctgaaggaaaccgtacgactccgtcagtcgttgcatttaaaaacggcgagcgccaagtaggggaagtggcgaaacgccaatcaatcacaaatcctaacacaatcatgtctgtcaaacgccatatgggtactgactataaagtggaaatcgaaggaaaagactacacgcctcaagaagtgtcagctattatccttcagcatctgaaagcatacgctgaaagctacctcggcgaaacagtttcaaaagccgttatcacggttcctgcatacttcaacgatgcagagcgccaagcgacaaaagatgccggtaaaatcgccggtcttgaagtagagcgtattatcaacgaaccgactgcagcagcgcttgcatacggacttgataaaacggacgaagaccaaacgattcttgtttacgaccttggcggcggtacgtttgacgtatctgttcttgaacttggcgacggcgtgtttgaagtccgttcaactgccggtgacaaccgtcttggcggggacgactttgaccaagtcatcatcgatcatctcgtagcagaattcaaaaaagaaaacggcattgatctttcaaaagacaaaatggcgcttcagcgtttgaaagatgcggctgagaaagcgaaaaaagatctttccggcgtatcatctacacaaatttctttaccgtttatcacagcgggagaagcaggtcctcttcaccttgagctgacactgacccgcgctaaattcgaagagctttccgctcaccttgttgagcgcacaatggctcctgtccgtcaggctcttcaagatgcggatctttctgcgagcgaaatcgacaaagttatccttgtcggcggatcaacacgtattcctgccgtacaggaagcaatcaaaaaagaaacgggtaaagaagcgcataaaggcgtaaaccctgatgaagttgtagcgctgggtgcagcgattcaaggcggcgtcatcacgggagacgtaaaagacgttgttcttcttgacgttacaccgctttctctcggtattgaaacaatgggcggcgtgttcacgaaactgatcgaccgcaacacgacaattccgacgagcaagtctcaagtattctcaactgcagctgacaaccaaacggctgttgacattcacgtgcttcaaggtgagcgcccgatgtctgcggacaacaaaacgctcggccgcttccagcttactgatatcccgcctgcaccgcgcggcgtaccgcaaatcgaagtttctttcgatattgacaaaaacggtatcgtaaacgtaagagcgaaagacttaggcacaggaaaagaacaaaacattacaatcaaatcttcttcaggtctttctgatgatgagatcgaacgcatggtaaaagaagcggaagaaaacgctgacgctgatgcgaagagaaaagaagaaatcgaagtccgcaacgaagctgaccagcttgtgttccaaacggaaaagacattaaaagatctggaaggcaaagtggacgaagagcaagtgaaaaaagcaaacgacgcgaaagacgcgctgaaagccgctatcgagaaaaacgaaattgaagacatcaaagcgaaaaaagatgagcttcaaacaatcgttcaagagctttctatgaagctttatgaagaagcggcaaaagcgcagcaggctgaaggcgcagcaaacgctgaaggcaaaaaagcggacgacaacgttgtcgatgcggaatacgaagaagtaaaagacgacgaaacgaaaaaataagttctttcccgcatggctttaggcggaagaacacacagcatattctgattcaacagacagaaagtcaaagtcaggcatctcttggctttgactttttttcttgcccgggataaaaggaattgaaaaaacataattcaaaatgatacaatctaatttatgtgagaaattcgggagagtgaagcgagatgagtaagcgtgattactatgaagtgcttggggtaagtaagagcgcttcaaaggatgaaatcaaaaaagcctatcggaagctttcaaaaaaatatcatcctgatatcaataaagaatccggagcagatgaaaaattcaaagaggtaaaagaagcgtacgaagcgctctcagacgaccaaaaacgcgctcaatatgaccaattcggccatacagaccctaaccagggattcggcggcggtttcggaggcggcggagacttcggcggcttcggtttcgatgacatattctcaagcatcttcggaggcggcacgagacgccgtgacccgaatgcgccgcggcaaggcgcggatctgcagtatacaatgaccctgtcatttgaagacgcggctttcggaaaagaaacgatcattgaaattccgcgcgaagagaattgcgaaacatgtaaaggatcgggcgcaaagccgggaacaaagccggatacgtgctcgcactgcggaggttcaggccagctgaacgtcgaacagaacacgccgtttggcaaagtggttaaccgaagagtctgccaccactgtgaaggaacaggaaaaatcatcaaaaacaagtgttctgactgcggcggcacgggcaaagtgaaaaaacggaaaaaaatcaatgtcacgattcctgccggtgtggatgacggacagcagctgcgcgttccgggtcaaggtgaacctggcgtaaacggagggcctgcgggagatctgtttgtcgtattccatgtgcgcgcccacgagttctttgaacgcgacggagacgatatttattgcgaaatgccgttaacgtttgcccaagcggcactcggagacgaagtggaagtgccgacgcttcacggaaaagtgaaattgaaaatacctgccggcacacaaaccggcacgaaattcagattaagaggcaaaggcgttcagaacgtccggggctacggacaaggcgaccagcacattgtcgtccgcgtcgtcacaccgacgaatctgacagacaaacaaaaagacatcatccgcgagttcgctgaagtcagcggaaacctgccggatgaacaagaaatgagtttctttgacaaagtaaaacgcgcatttaaaggcgagtaatgattggataggagttggtagttttgaaatggtccgaaatcagcattcacacaacacatgaagcggtcgaacccatctcaaatattttgcatgaagctggtgcgagcggggttgtcatcgaagatccgcttgatttaatgaaagagcgtgagaatgtttacggggaaatctaccagctcgaccccaatgattaccccgatgagggtgtcattgtcaaagcgtatctgccgattaacagtttcctcggcgaaacggtggacggcattaaagagacgataaataatctgcttttgtacgacattgatttaggcagaaacacaatcaccatttctgaagttaatgaagaagaatgggcgacagcttggaaaaagtattatcatccggtgaaaatttctgaaaaattcacgatcgtacccacatgggaaacgtacacacccgtgaataccgatgaactgattatcgaaatggatccgggcatggcattcggaacgggaacgcatccgacaaccgttctgtgcattcaggcgcttgagcgtatcgttcaaaaaggcgaccgtgtcattgatgtcggcaccggttcaggaattttaagcatcgcggccgccatgcttgaggccgaatcggttcatgcgtatgaccttgatccggtcgctgttgaaagcgcgcgtctgaatctaaaattgaacaaagtgagtgatacggccgaagtgaagcagaacaatttgttagacggcatcacgggcgaacatgatgtcattgtcgcaaatattctggcggaagtgattctccgctttacatcacaggcgtatgacctgctcaaagacggaggccattttattacttcaggcattatcggccagaaaaaacaggaagtaaaagaagcgttggaaaaagccggctttaccatcacagaaattctgtctatggaagattgggtcagcatcatcgcgaaaaaataacagttagtaggtgtcacagcgtatgcaacgatattttatcgagctcacgaagcaggagatggacgaaactcccgattttcaaattacgggggaagacgtccaccatatagcgaacgtcatgagaatgagtgcgggagaccggataatctgctgttcgaaagacggccatgaagcgttatgcctgctcaaagcggtttctaaagatcatatatcatgcagcattgctgaatggacgggtgaaaaccgtgaactgccgttaaaaatcaggattgccagcggccttccgaaaggcgataagcttgaatggattatccaaaaagggaccgagctgggggctagtatgttcatcccctttcagggcgccagatccgtcgttaagctagacgacaaaaaggcaaagaaaaagcgggagagatgggcgaaaatcgcgaaggaagcggcggagcaatcgtaccgcaatgaaattcccgaagtgaaaaccgttcatacgttccggcagctgcttgaaatggcggagaatgtcgataaatgtgtcgttgcatacgaggagtcatcaaagcagggagaaacgggcgctttcgccgcggagcttaaaagccttccgcaaggttcgtctcttttaatcgtattcggccctgaaggcggtctgactgagtctgaagttcatcagctttcagaaaaaggcgccgtcttatgcggcctcggaccgagaattttacggactgaaactgcgcctctttacgcgttaagcgcagtttcctatcatacagagttattaagaggtgatcagtaatggcaactgttgcttttcatacccttggctgcaaggtcaatcattatgaaacagaagcaatctggcagctgtttaaagatgcgggttatgaacgaaaagaattcgaacagacagcagatgtatatgtcattaatacatgtacggtaacaaacacgggagataaaaaaagccgtcaagtcatcagacgggcgatccgccaaaatcctgacggcgtcatctgcgtaacagggtgctatgcgcaaacctctccggcagaaattatggccatcccgggtgttgacatcgtcgtcggcacgcaggatcgtgaaaaaatgctcggttacattgagcagtacagggaagagcgtcagccgatcaacggcgtcggcaatattatgaaagcacgcgtgtttgaagagctggatgttcccgcttttactgaccgcacaagagcgtcgttaaaaatccaagagggctgcaacaacttctgtacgttctgcattatcccttgggcgcgcggcctgcttcgttcccgcgatccggaagaagtcattaaacaggcgcagcagctggtggatgccggctataaagaaatcgtcctgacggggattcatacgggcggctacggcgaagatatgaaagattataatttcgccaagcttctccgcgagcttgatacacgtgtagaaggactgaagcggatcagaatttcatctattgaagcaagtcaaatcactgatgaagtgattgaagtgctggatgcgtctgataaaatcgtccgccaccttcatatcccgattcagtcaggatcaaacaccgttctgaaacggatgagacgcaaatatacgatggaatttttcgcggaccgtttaaataagctgaaagaagcgctgccgggtcttgccgtcacatctgatgtcatcgtcggtttcccgggtgaaacggaagaagaatttatggaaacataccggttcattaaagaacataagttttcagagcttcacgtattcccttacagcaaacgcaccggaacacctgcggccagaatggaagaccaggttgacgaaaacgtgaaaaacgaacgggtgcataagctgattgcgctgtctgaccagcttgccaaagaatacgcctccgattatgaaggagaggttctggaaatcattccggaagaggcgtttaaagagtctgatgaggacggcatgttcgtcggctatacggacaattacatgaaagtcgtcttcaaaggcacggaagatgtaatcggcaaacttgtcaaagtcaaaattcaaaaagcgggctatccgtataacgaaggacaattcgtccgcgtcgttgaggatgaaatgacccgaaacatgcgcatgtcttcataacagataaaaaaaccggtgccttcccgcatcggtttttttacggtttcggaggaatcagcctgtcaatcagccggtaaaacaaatgtgtgaacggcagaaacaataaggcggtgactacgttaaataacaggctgaaatgcgcaatcatctgcgcgggatcatcagacaggcgctccgtaatacctgctgatgcagacaggaagggaaagacgagcagcacgccgagaatattaaacactacgtgagcaccggcggtctgtctggcggcataaccgcctgaaacagcagccatgacggccgtgacgcatgtcccgatattagatcccagaacgacgctgaccgcttgttcaatgccgatcaccccttcgttcataaaactcatcaaaatgccgatgcagacggagcttgaatgaatgattgccgtcaatatcatgccgataaaaagagcggaccagctcgaatcattcacatggcgcaaaacctccgccccgccttcatttctgtcagcggaacggcaagccggctgaagcatgtgatgcaaaaaaagatgatgccgagaccgaggaagcttataccgatctgcctgaacggatatttacggatgaggataaacacaaggcctccgataaaaagcacccaaatgagcacatccatctttatggctaaaaactccgtcgtaaacgtggagccgacattcgtgccgagaatcatcggaatggtccgtttaaaagataaagcgcctgcgctgacaaagccgatgacaatgaccatgaaggctgagctgctctgaagaaaaccggtgaatacgatgcttatgagaaaagctttcaaagggtggtcggtaaataagagcaggcttttctcaatttttgaatacgttaatgcgatcaggccctgcctgagcaggctcattccgagtaaaaaaaccaggataagtgcggtaaagagaatcagtattatcaaacgaaacacccctttccatcattatatagacaagcagccttattcatgacggaaaagtgagctcgcttagttgacctgactgatggcttatattataatgtcaaagtacatgtttatatatgtatctttttaaaggtagtcgattggtgtattcggagggagggaaagagaatgtcaaaaacggtcgttagaaaaaacgaatcgcttgaagatgctcttcgtcgcttcaaacgcagtgtatcaaagacaggtactttgcaagaagcaagaaagcgcgaattttatgaaaaacctagcgtaaagcgcaagaaaaagtcagaagctgctagaaaacgcaaattctaaaagagggtggatttatgagtcttcttgagcgacttaaccaagatatgaagctgtatatgaaaagccgtgagaaagacaaactgactgtcgttcgaatggtgaaagcttcacttcaaaacgaagcaattaagcttaagaaagacagtttgaccgaggatgaggaacttactgtcctatctcgtgaacttaagcaacgtaaagactccctccatgaattttcaaacgctgatcgtttagatttagtagataaagttcaaaaagagctggacattttagaaatttatttaccgaagcagctttctgaagaagagctgcagacaattgtaaatgaaaccatcgctgaagtcggtgcgagctccaaagcggacatgggcaaagtgatgagtgctattatgcctaaagtaaaaggtaaagctgacggcagtgtaattaacagacttgtcagcagtcaattatcttaattgacaagaaaaaagacatctttcctagagagatgtctttttttatacataaaaaaatgaaactaaagtacatttgttacgtatataaagaagaacgaaacgggaaggagggtatatttgccttgttccgaaaaaaaaacggaattgctgttgctctattgggcttatttgtattatctttattaggggttcaattgaacgcgaaagctgatcacccatcggtttatgtcatcccggttgagaaaaatgtcgaacaggggctcgcctcgtttttatcgcgttctttcaaagaagcgaaggagtccggcgcgtcacacattattcttgacatcaatacaccgggaggcgccgttcaatcagccttggatattgcggatatcatcggccgcgcggatgtgcctgttaccgcttacgttaataaacgggcgctttctgccggagcgtatatagcgcttcaggcagatgaaatctatatggcgccgggcggaaaaatgggtgccgcagccatcatcgacggaaaaggaaacgcggcggacaaaaaggctcaatcactgtggcatgcagaaatggaggacgcagcggttaaaaacaaccgaaatccgaaatacgccctggccatggcagatcccgccatcaatgcaaaggaagcgggcgccccaaagggaaaactgctgacactgacagctgaaaaagccaaggaagtcggatattcggagggcacggtttcagaccttgatgctttatatacaaagctcggttttgacaaagcggatgttcaccatgcaaaagaaggttttgtcggcaaattgggcagatggctgacaaatccgtttgttgtccccgtcttattaacgcttgctttgcttggtttgaccattgaattgttctcgccgggcctcggaataccgggtgccgtcggactgacggccatgctgctgtttttcaccgggcatatcgctgccggattcgccggctatgacagcgtattcttattttgcgcgggcttggtttttatccttttagagatatttctgcccggaggcataatcggtcttatcggtattgcaggcgtcatcgcgagcctctttctcgctgcgggcagctttaccgtaatggcggtttctctcttgatcgccattgctgtgtctattacagcctttatcatattaacaagggtgttggggaaacgaatgaaattctttaaaaaattaatattaactgattcaacaagcacggagagcggttatgtttcaaatcagaaccggacggagctgttggggaaagtcggcattaccgctacagccctcagaccgtcaggcaccgtcattattgatgatgaacgtctggatgtcgtctcggaaggatcattcactgaaaaagacagacaggtgaaagtagtgaaagcggaaggctcacgcattgtcgtgagagaaatatagatgataaccttgaggaggaattagatggaactgtcaagtttggcgattttagcaatagttgcagctgccataatcgtgttagccatattcttcacctttgtaccggtgatgctatggatttcggcgcttgcggcaggagtcagaatcagcattttcactttggtcggaatgaggctgcggcgcgtcataccaagccgcgttgtcaatccgttaattaaagcgcacaaagccggcctatccgcaacaacaaatcagctcgaaagccattatctggccggtggtaatgttgacagggtggtcaatgccctgattgcggcacagcgcgccaatattgagctgacatttgaacgctgcgcagccattgacctggccgggcgtgacgtattggaagccgtgcagatgagcgtcaatccgaaggtcattgaaacaccgtttatcgcgggtgtcgccatggacggaattgaagtaaaagcaaaagccagaatcaccgtaagagccaatatcgagcgccttgtcggaggagcgggagaagagacggttgtcgcccgtgtcggagaagggattgtctcgacaatcggttcctcgggtaatcataaaaaagtgcttgaaaaccctgatatgatttcgcagaccgtacttggcaaagggctggattcaggcaccgcctttgaaattctttcgattgacatcgccgacgttgatatcggcaaaaacatcggagcgattcttcaaacggatcaagcagaagcagacaaaaacattgcgcaggccaaagccgaagagcgccgcgccatggcggtcgcccaagagcaggaaatgcgcgctcgcgtagaagaaatgcgtgcaaaagtcgtggaagcagaagccgaagtgccgcttgcgatggcagaagcgctgcgtgaaggaaacatcggcgtcatggactatatgaacataaaaaatatcgacgcggatacggacatgagggattctatcggcaagctgacgaatgaccagcaagatgaagaccaacaataacctctctattaaggagggagccgctatatgcacgagattctgacaaatccgctcgtcattgccgccgtcatcggcattatatcggcaatattcggcaagaaaaacaaagatgaaaaacggccgccgggtacacgccccgaaaatcagacaaaaaagcaggatcaaaaacagccgcagaaagagcataagccggaagcggaagaattgcctgccgtttcagaagagaacccttttgagcaaaaaagaagggaagctgaaaagcgcctagcggagacggagcagatgtttaacgggcttgaacataagctgacatctcaacgcgcacgaaacgcgtctctgaagaaatcagccctcaaaataaataaagaaactgcggttcaaggcattatattcagtgaggttttgggtccgccccgtgcaaaaaaaccgcaccggaccatgcggagcatcggtaaaaaataaagtgttagaaccccttttcaaatcatacatatgagatgaaagggggttctttttttatggggcaaagaaagaatcgtgtaaaggcatggctgacaagagcattggaaattcccccggacgttatgatggatctgcctcggattacgatggtcggcagacttcatatctacatagagaatcacagaggcctcctgctgttcagcgaagaagaagtcaggctgatgctcaagcaggggcaatgtatcatatcaggaaaaaacttggtcattaaggcaatccttcctgaagaaattcttttggaaggcacgatagatcacgtacgatatgtcgattcataaagccggggggaaataatgtgaaaaacaaatggctgtcatttttttcgggtaaagtccaaatggaagtcaaaggaaaagggattgaacggttgctgaatgaatgcacgagaaacggaatcgccatctttgcggtgaaaaaaaagcaagactgtgttctgctgatgattcagcttcaagatgtacatgctttcagaagagtcatcagaaaacatgaatgcaaagcaagctttacaaaaagaaagggtcttccctttctgcttctcaaatcaaaattaaacctgggcttcactgcgggatttgtgatgtttttcgttatattgtttcttttgtccaacatgatttgggacattgatattaaaggggccaagcccgaaaccgagcatcagatggtaaagcaccttgaagaaatcggtgtgaaaaaaggacgtttgcaatttttaatgatgacgccggagaaaattcaaaaatcattaacaaacggcattgataatattacgtgggtcggtgtggaattgaacgggacagcccttcatatgaaagtggtcgaaaaaaacgaaccgacaaaagaaaagtacgtgagcccccgccatatcgttgccaaaaagaaggcggtcatcaaaaggatgttcgtgcaaaaggggcagccgatggcttttgtgaacgatcatgttgacaaaggacagcttctcgtctcaggactgatcggaaatgaagatcggaaagtcgcctcaaaagcggaaatttacggagaaacatggtacaagtcagaagtaaccgtgcctcttgaaacatcatttacgctatatacgggtaaagtaaggacgaagcacaagctgtctttcggatcatggggcgtgcctttttggggctttgaatttaatgaggagccgctgaaacatccgaaaacagaggaagaaaagcacccgtttcaatttctggggatgaagcttccgatttcttacgttcaagaacagacaagagaaagtgaaacaaccgtgcggacttatacgaaaggcgaagcggttcaggccggtatcaaaatgggaagacaagatgtagaaaagcgattaaacggcagcggagaggtggaaagtgaaaaagttttgcaccaatccgttgagaatggtaaagtaaagttgattattctctaccaagttatagaagatatcgttcaaaccacacctattgttcagggagactaaagaatggcagaacatttacttgcgattaatcacaaactgaaaagcccggacgaagcactttctttgttcggcagccaagatgcctttttacatttaatggagaaggatctgggcattagcctcatcacgcgcggtgaaaccatttacgtttccgggaatgatgaaacatttgagatcgctgacagattattgggctcgctccttactttaattcgcaaggggatcgagatttcggaacgtgatgtgctgtatgccgtgaaaatggcaaaaaaagatgaactggactattttgaaagcatgtatgaagaggaaataacgaaaacggcaaaaggcaaaccgatccgtgtcaaaaccctcggccaaagagaatatgtggcggcgatgaagaaaaacgacatggtgttcggcatcgggccggcgggaaccggcaaaacttatttggcggtcgtaaaagcggtgcatgctttaaaaaacggccacattaaaaaaatcattttaacaagacccgctgtggaagccggcgagagcctcggctttctgcccggagatttaaaggaaaaagtagatccttatctgcgcccgctgtatgacgcgctccatgatgtgctcggaagcgaccatacggagcgtcttatggaaagaggggttattgaaatcgccccgcttgcctatatgagagggcggacgcttgacgacgcgtatgtgattcttgatgaagcccagaataccactcccgctcaaatgaaaatgtttttgacgagattgggttttggctctaaaatgatcattacgggcgacgtaagccaaattgacctgccgaaaggcgtcacatcgggacttgcagtagcgaaggatatgctgaaggacataaacggcatctccgtgattgaacttgaccagacagatgtggtcaggcatccgcttgttgcaaaaattattgaagcttatgataagcaaaagtaatgcaaaaatgacccgatctcccgttatcgggtcatttttatatgatgtgttcctgatgtttcagggaggaggttcttgttttgaaaaagaaggaaaagggcaaaagcgcccgggaacggttccgcagtttcagacatgcccgctcagcccatgtgctgctgtacctgctgctttcagcgatcatgtttggtttgctctttattcatgtaaaacctgaatcacttaatttggatttgttttcagtcagtgataagacgatttacgcgcccgccacagtggaagatcagcaggcgacggaatcgaaaaaacaggcggccgaagatgcggtggaagatcaatacaccctgaaaaaaggctataccgacaaccggcttgacctgatcacttccatttttgacagcatcggcgaagtgaaaaaagatgcggaaaaagacaaaaagtcaccttcggaaaaatcattggtcaaatcggtgaaaaacaagctgacacaggatgtcaatgaatccgtctcggaagatgccattaaatcgcttctccatgcaaacaatgaagatttctcatttgtgagggattccgtcattaccgcggtgaatacggtgatgagcagtgaaattccttctgaaaagcttgccgaagcgaaggataaggtcgcaaaagagctgaaaagcgcttctgtgccgtcaaaatatttagcggctgcgactgaaatcggaaaatacgcggtcattccgaattacgtatttgatccgaaagcgacggatgaaaaacgccaggaagcgtcagacagcgtccagccggtacagatcaaacagggacaggttctcgtggaagagaatgacctgatcgaccgggaagtatacaggaagcttgaactgacggggcttttgaataattccaacctgttaaagccgatcagcggtctgcttctgatgatcgggctgtttatcgccacgcttgtctactattttgagaaacagcagcaggagcttaagctgaaaaataaatctcttttgctgttttctatcattacaacgcttattctcgtcattatggaagtcgtcagtctctttcagaagattgaatacaccaatatcggctatcttgtgccgatcgccgccggcgcgattttaatcaggctgctgctcaatgaaaggctcgccattttgggaagcatcattctggcgatctgcggcagtatgatgtttaatcagggtgtgacgggaacatttaattacgtcatcggcatttactatttaatcagcagcatttcaggcattctgtttttggggaaacacaatgcgagatcaaaaatattgcaggcgggactgttcgtctcatttattaatatgattatcgtgctgtcgcttttattaatacaaaatacggcgctgtcacctgttgaaatcggaacgctgatgctgatgggggtcgtctcgggacttgcttcatccgttttgattatcggtctgatgccgttttttgagacgggattcggcattctttcaacgatgaggctgattgaactgtctaatccgaatcatcccctgcttcgaaagattttaacggaaacacccggtacatatcatcacagcgtcatggtggcaaatctgtcggaagcggcttgtgaagccgtaggggcaaacggtcttttagcacgggtcggagcatattatcacgatctcggcaaaacgaaacgtccgcaatattttattgaaaatcagatgaatatggataatccgcatgacaagctgtctcctcagctcagtaaaaatatcattatcgcacatacgacagacggtgcgaatatgctcagaagctataagtttccgaaagagcttgtggatatcgcggagcagcatcacggaacgtcccttttaaaattcttttattataaagcgaaagaaaagggcgaccagattacagagaaagagttccgctacccggggccgaagccgcaatcgaaagaagcggctattatctcagtggccgacagcgttgaagccgccgtccgttccatgcataatcccaatcccgagcggatcgaaaaactggtgcggggaattatatccgataagcttcaggacggacaattctcagaatgtgatctcacgttccgagaactggatacgatcgccaaaacactatgtgcgactttaaaaggaattttccactcccggattgaatatccggaggctacgaagaaggtgaaataaatgggtttactcatagatattgttgatgaaacgaacagcgtctcagctgatgcgctccaagaagtggagaagctgctccaattcgcggcggaaaaagaaggcgttcaggatcaggctgaagtatcggtcacgattgtgacaaatgaagaaatcagagaaatcaacagagactaccggggaaaagacactccgactgacgtcatttcgtttgcgcttgaagaagaaggcgaagacgaggtggaaatcgtaggcgccgacatgccgcctgttttaggagatattatcatcagcgcagacagaacgaaagagcaggcggaagagtacggccattcgtttatgagagagctcggttttctggccgtgcacggctttttgcatttgcttggctatgatcacatgacaaaagaagaagaggaagaaatgttttcaaagcaaaaggatttgctggatgagtatggactcacgagatcataaaaacgagtggagcaggttcctgaagagctttgtccatgcatggaggggaatctggaaaacggcgcggtcagagcggaattttcaatttcatattaccgcggcctgcgccgttatcgtttgcggttttctcaccgggctgagcacagccgaatgggccgttgttttggtgctgatcggagggatgcttgctttggagcttttaaatacggcgatagagcatgttgtggatttagttactgatcagtatcacccgctcgcaaaagcggcaaaggacgcggccgccggagccgtttgcgtctttgccgtgatatcgtgtatcattggtttactcatcttcctgccgaagatatgttagcagaagattcttacaattattttacattgccaaaaatgggcgtgaaaaaccgatcataattatgtaaaataaaagtgacagcggtatcatacaggataaaggtaagagaggaattaagtacacatgaacagacaagaattgattgcagaagcattaaaagcacgggacacagcgtatgtgccgtattcaaatttcagagtgggagccgctcttcttaccaaagacggaaaagtgtacagaggctgcaacattgaaaatgcggcatacagcatgtgcaactgtgctgaacgcacggcgatattcaaagctgtttccgaggggatacggaatttgcgatgctcgccgtggctgcggatactccgggaccggtttcgccgtgcggagcctgcagacaagtaatttccgagctgtgctcaaaggatatgcttgttattctgaccaacttacaaggacaaataaaagaaatgactgcggaagaattattgccgggcgcattttcatcggaggatttacatgacgaacgaaagctttaaatcaggatttgtatctatcatcggaagaccgaacgtaggaaagtctacctttttaaacagggtcatcggtcaaaagatcgccatcatgagcgacaaaccccagacgacaagaaataaagtccaaggggtgctgacaaccggcacgtcgcagactatttttattgatacaccgggcattcacaaaccgaagcacaagcttggcgactttatgatgaaagtggcgcagaatacgctgaaagaagttgacttggtgttatttatgatcaacgccgaagaagggtacggaaagggcgacgagtttatcattgaaaagctcggacagacgtccacgccggtctttctgatcgtaaacaaaattgataagatccaccctgaccagctgcttcttttaattgatgagtaccgtgcgcgctatccgtttaaagaaatcgtgccgatctcagctttggaagggaacaacgtcgaaacccttctcgcgcaggttgaagcgtatttaccggaagggcctcaattctatccgagcgatcaggtgactgaccatcccgagcggttcattatttctgaactgatcagggaaaaggtgctccatctgacaagggaagaagtgccgcacagcatcgctgtcgctatcgagtccattaaagggcaggaaaacggctccgtccatgtcgccgccaccattgtagttgagcgggattctcaaaaaggcatcgtcatcgggaaaaaaggagcgcttctgaaagaagtcggcaaaagagcgcgggctgatattgaagcgctgctgggttcacgcgtttacctcgaattatgggtgaaagtgcagaaggactggcggaataaaatgtctcagctgcgtgatttcggcttcaaagaggatgaatattaattcatctaaagcgcatgcctgatgtgtgggattacctcacagaaacagggcttcgttagcaaaatttgtttaacatgaaaaggaggacatcaggtcaagataagggtaagaatttggattggcaagctagtttaatgatgaaaggtgggttttttgtgttgaattttacctggaacgtattttctcaaacaggaagtgttgatacgtaccttctttttaaagaactggaaaaagagaacctggaaagacccgaagaaccggaagatgagctagcccgaattgattttccaattttgtaaacctcttggcccctcccgttgttggaaggtgcggaaatgctgactaaatgtgaaggaatcgtgctccgtacgaatgactacggggagacgaataaaatcgtgacattgctgacgagggaacacggcaaaatcggcgtcatggcaaggggcgccaggaagtcagccagccggctgtcagcagtcagccagccgtttttgtacgggtcatttttaatgcaaagaacatccggactcggcacgctccagcagggtgaaatgattctcagcatgagaacgatcagagaagatttatttttgacggcgtatgccgcttttatcgctgaactcactgacaaaggaacggaagagaagaaaccgaacccctatttattcgaattgattctcgaatcctttaagaggctgaatgacgggactgacccggacgtgatcacattcatcgtgcagatgaaaatgctcggcgtcatggggctgtatccggagctgaatcattgtgtccactgcaaaagcggggaagggacgtttcatttttcgataagagataacggttttatctgccaccgctgctttgaaaaggatccgtacagagttccgatttcgccgcaaacggcaaggctgctaaggcttttttattactttgatatcggaaggctcggcagcgtctcgttaaaacaggaaaccaaaaacgaaattaaacaggtcattgatctgtattacgaggaatattcaggactttatttaaagtcaaaacggtttttagaccagatggaaagcatgaagaaccttttggatgaaaacaaaagttgacattctgcccatctttttatatgatcatttattataaaatatgttgcagtgacagaaagaagtacttgcgtccaactcatacaagcgaccttaggacagtgtaagctaaggatgagcgcgcaacgaaaggcattctcgagcaaccctttaaaaagaggctgagtgattcacatcctcagcaactagggtggaaccgcgggagaactctcgtccctatgtttgcggccggcaagcatagagacgggagttttttggttgccgccgcacttgtaaaagaatggagaaagtggaggtgcttgaaatgaacattcaagatatgattttaaccttgcagaagcactggtcgaatgaaggctgtgtgctcatgcagtcgtatgatgtggagaaaggcgcaggcacaatgagcccgtatacatttttacgaagcatcgggccggagccgtggagagtggcttacgttgagccgtccagacggcctgcggacggacggtacggtgaaaacccgaacaggctctatcagcatcaccaattccaagtcattattaagccgtcgcctgataacattcaagagctttaccttgattcattgcgtgcgctcggcattgacccgcttgaacatgatatccgtttcgtagaagacaactgggaaaacccgtctttaggctgtgcaggtctcggctgggaagtatggcttgacgggatggaaattactcagtttacatatttccagcaggtgggcggaattgaatgtaagccggtgtccgttgagatcacatatggtattgaacgtctcgcgtcatatattcaggataaagaaaacgtctttgatcttgaatggacgtcaggatttactgtgaaagatttatttatgatggctgaatatgagcattccgtttatacttttgaaacatctgacgtggatatgcttttccatttgttcagcacctatgaaaaagaagcgatcagacaaatggataacgggcttgtgcatccggcctatgattatgtgctgaaatgctctcacacatttaatctgcttgatgcaaaaggcgcgatctcggtgacagagcggacgggttatatcggccgtgtccgcaacttagcgagaaaagtggcaaaaacgtattatgaagaacgggaaaaattagggttcccaatgcttaaagaggagggctcttcccatgagtaaacaagacttgcttttagagatcggactcgaggaaatgccggcgcggtttttacatgacagcatggtgcagctcggtgaaaagctgaccggctggcttgctgaaaaaaatatcgcccacggcgaagtgaaactttttaatacgccgagacgtctggcagtatatataaaagacgtagcagaaaaacaggctgatattcaggaagaagcaaaaggccctgcgaaaaaaatcgctctggatgctgacggaaactggacaaaagccgctatcggattttcaaaaggccaaggcgccggagtggatgacctgtatataaaagatgtaaacggcacggaatatgtcttcgttcaaaaattccaggcgggacaagagacgaagacacttttaccgcaactggaaaatttgattgccggaatgcattttccgaaaaacatgcgctggggcacgcaggatctgcgctatatccgtccgatcaaatggattgccgccctctttggaaaagacgtcattccgtttgaaatcacaaatgtcaagacgggccggaacacgcagggacaccgctttctcggccaagaagtatctgttgatgcgccgtcatcatacgaaaagctgctgaaagaacaaagcgtcattgctgacccgaaagaacgcaaacaaatgatccaaagccagctggatgcgcttgcggccaagaagaaatggaacattccggtcgatgaggatctgctgaacgaagtcaaccatctggtggaatatccgacggcgctttacggatcttttgaatccgagtttctttctatccctgaagaagtgcttgtgacaacaatgaaagagcatcagcgctacttcccggtaaaagatgaaaacgggaatttgcttcctcattttattacggtgcgaaacgggaacagccatgcaattgaaaatgttgcccgcggaaacgagaaagtgctgagagcaaggctttcagatgctgcgttcttctacaaagaagaccaaaagctgaacattgatgaaaacgtgaagaaattggaaaatatcgttttccatgaagagctcggctcccttggagataaagtaagaagagcggtcaccattgcgggcaaacttgccgtccgcctgaaagcggatgaacagacgcaaaaacttgtgaagcgcgccgcagagatttctaaatttgacctggttacacatatgatctatgagttccctgagcttcaaggcgtgatgggagaaaaatatgcgcgcatgctcggtgaagatgatgccgtcgctgccgctgtcaatgagcactatatgccgagagcggccgggggagaagtgccttcaacctttatcggcgcggtcgtggcgttagctgataaactggacacgattgcttccttcttcagcattgacgtaattccgacaggttctcaggatccgtacggattgcgccgtcaggcaagcggcattgtttccattctgatcgaccgcaactggggcatttcttttaaagaactgctgtcgttgacagaaacggaaaaagagaatgagctccttgatttctttacacagcgtctgaaatacgtattaaacgctgaagacatccgtcatgacgttattgatgccgttctggacagcacagagcttgagccgtatgcagccgttcataaggcaagagtgcttgagaagcacctcggcacacccggctttaaagaaacggctgaatcactcggccgggttatctccatcagtaaaaaaggcgagagccgcgatatcaagccggatctgtttgaaaatgaacaggagaaaaagctgtttgacgcttatgaaaaaacaaaagacagtgtcgcggaaagctttgcctccaaaaactatgaacaggcgcttgccgtgctcagcggattaaaagagccgatcgaagattactttaatcacacgatggtaaatgcggacgatgaagcattaaaaaccaaccgtttagcgcaaatgaccgctcttgcagatgtgatcaagtcttttgctaatatgaatcatcttattgtaaaataaagaaaaagacggttgctgtgtgatcggcaatcgtcttttccccttttacataaacatcacagaatgaaaacatagataaagaaacccttccataaaggtggtgagtacgatcgaattaaataaacggcaagaacaaattttacagattgtaaaggaaaacggcccgattaccggagagcatatcgcagaacagctcaatttaacgagggccacgctgcggccggacttggccatactcaccatgtcaggcttcttagaggcccgtccgcgggtcggttatttttatacggggaaaacgggaaatcagctgcttgcggataaattgaaaaagctgcaagtgaaagattttcaatcgatccctgttgtcatcaatgaaaatgtctcggtatacgatgccatctgcaccatgtttttagaagatgtcggcacgttatttgtcgtagatcgtgatgctgtcttagtcggtgtgctgtcacgcaaagatttgctgcgggcgagcatcggccagcaggaacttgcctcaataccggttcatattatcatgacaagaatgccgaatatcgccgtctgccggcgtgatgattatgtgatggacatcgccaagtatttaattgaaaaacagatcgatgccctgcccgttattaaagatacggataaaggctttgaggtcatcggccggtttaccaaaacgaatatgactaagatacttgtcagtttatcagaaaatgaaatcatataagcttgaaaactaacgggggataacatggacaatcgcatcatttatgtagtatcagactcagtcggagaaaccgccgaactcgttgtaaaagcctcgctcagccagtttaacggctcagccgatgatacgcatatcagaagaataccttatgtggaagatatcggcaccattaatgaagtcgtgtctctcgccaaagcggacggcggcattatttgttttacgctcgttgttcctgaaatgcgcaaatacctggttgaacaagcggaaaaagcgaatgtgctgtattacgatattatcggtccgctcatcgataaaatggaatcggcttacggtttgaccgccaaatatgaaccgggccgcgtccggcagcttgatgaagattatttcaaaaaggtcgaggcgatcgagtttgccgtcaaatatgacgatggcagggatccaagaggcattttaaaagccgatatcatcctgctcggagtatccagaacgtctaaaaccccattatcacaatatcttgcccataagcgtctgaaagtggccaatgtgccgatcgttcctgaggtcgacccgccggaagaactgttcagcgttgatccgaaaaaatgcatcggcttaaaaatcagccctgataaactgaaccatatacgtaaagaacggttaaaatctctcggcttaaatgacaaagccatttacgccaatatcaacagaattaaagaagagctggagtattttgagaaaatcgtggaccggatcggctgccaagtcgttgacgtttcgaataaagcagtcgaagaaacagcgaacatcattcatcatctcaaaacaaagggccgataactcaggacgctttatcctgggtttttgggtatgcaaatagggaataaacaaaaaggatggcatcttcgcgaagtttgtattataataaaaaattgtgataaaatgtttatttttaggtttaagcttcgtgtgatacgaataaactattatgggtaagatgtcaagaataactcccggaaatttttcgacaaagctcaaaatagatccgcagtcatggagcatatgcgatttcgcttgtttttatgcaggagattgatggagggatggagaattagtcttctaaatgaaaaagaaaagacgatttttgtcgatgcagacgcatgccccgtaaaagaggaaataatgctcattgcatcgcaattcagcgttcgggttattttcgtcgcatcatttgaacactaccagctttccagaagcaaagacgagaactgggtatacgttgatcctcataaagaagcggcagatttatatatcgcaaaccatgtgagatcgggagacgtcgtagtcacgcaggatatcggtttagcatctcttttgctgaacagaaatattgccgtcttatcggaaaggggccgttcttatactgaagacacgattgacttcgctctgatgagccgtcatatgtcaggcaaaatgagaagaagcggcattcattccaaaggacctaaaaaattaaataaagaagatcggaatcgatttgttaccctgcttaaaaaaatcctgtcgaatgatgaagggatttcaaatcaaaacatcgaataatgtacgacggagtgttataagatgggaaaccgcataccagatgaagtagttaatcaggtgcagcagtcagcagacattgttgaagtcataggtgattatgtccaattgaaaaagcaaggccgcaactactttgggctctgtccgtttcacggggaaaacacgccctcgttttccgtctccagcgataagcagatctttcattgcttcggatgcggagcgggcgggaacgttttctctttcttacggcagatggaaggctattcatttacggaagctgtttctcaccttgcggataaatatcagattgatttccctgatgatataacgattcactctgcatccaggcctgaatcttccggagagcagaagatggaggaagcccacgagcttctgaagaaattttaccatcatttgctaataaatacaaaggaaggccaggaagcgttagattaccttttatcaaggggttttacgaaagagctcatagatgagtttgaaatcggctacgcgctggattcctgggatttcatgacgaaattcttgaaaaagcgcggttttgaggaagaaatgatggaaaaagcgggtctgctgatcagaagagaagacggcagcgggtattttgaccgtttcagaaacagaattatgtttcccattcatgatcaccacggagccgtggcggctttttcaggaagggcgctcggaagccagcagccgaagtatatgaacagcccggaaacgccgctgtttcataaatctaagctgctgtataactttcataaggcgcgcctgccgatcaggaaagaggagagagccgttctgtttgaaggcttcgctgacgtcatatccgccgtcagctcaggcgtaaaagaaagtatcgccacaatggggacgtcgctcaccgaagagcatgtgaaaatcctcagaagaaatgttcaggaggtcattctctgctacgattcggataaagccgggtacgaagctacgctgaaagcggccggcctgctccagaaagccgattgtaaggtaagagtaagcatgctgcctgacgggcttgatcctgatgattatatcagaacccggggcggagaaaaattccggaccgatatcattgatgcaagcgttacggtcatggcttttaaaatgcaatatttccgcaaagggaaaaacttatctgacgaaggagaccggctcgcttatatgaaagaagtgctgaaagaaatcagcgctctttccgggtcgcttgagcaggaaatgtatgtgaagcagctcgcctcagaattttctctttcggtagaatctttgacggaacagctttccatctacgccagacaaaacgcccccggcgacaaaaacgccgaaccgcagacaagacgggcccgggtgacgactaaagcgaaacggcgccgtctccgtcccgcctatgagaacgcggaaagacttctgctcgctcatatgctgagagaccgaaacgtcatcaagaaagtgattgagcgtgtcggctttgaatttaacattgacggacatcgtgcgctggcagcatacctgtacgctgtttatgaagagggtgctgacatgacgccgcagcatcttatggcgagaatgcaggatgaggaaatcagccagctgctttcagatatagggatgctccaagtaaacgaggagctctcagaggccgagttatccgattacgtaaaaaaagtgttggatcaccgaaaatggtcaatgataaaggaaaaagaagcagaaagagcggatgcggagaggcagaaagacttcgtgaaagctgcgtctctggctcaagaaattgttgcattgaaccgatcattaaagtaacaacaaatagaggcttgcgttctgattggcaatgattccttgcggaggagcaaatagatcgcttaacctcatcatgaattgtcattattatccgcagccctgcatgctgaaaaagagagaaggcttccgggtcggataagaaacataccgcttttagaattcgttgcaagctttggaaggagggatccataatggctgataaacaaacccacgaaacagaaacagaacttacattagaccaggtaaaagagcagcttactgaaactggaaaaaaacgtggcgttttaacatatgaagaaattgctgaacgcatgtccagctttgaaattgaatcagaccaaatggatgagtattatgaatttttaggagaacaaggtgttgaattaattagtgaaaatgaagaaacggaagatcctaatattcaacagcttgccaaagccgaagaagaatttgaccttaatgacctcagcgtaccgcctggcgtaaagatcaatgatccagtccgcatgtaccttaaggaaatcggacgggtaaatcttctttctgctaaagaagaaatcacctacgctcaaaaaattgaagagggtgacgaggaatctaaacgcagactggctgaagcaaaccttcgtttagttgtcagcattgctaaacggtatgtcggccgcggcatgcttttcttagacttgatccaagaaggaaacatgggtctcatgaaagccgtcgagaagtttgactaccgtaaaggatataaattcagtacgtatgcgacttggtggatcagacaggcgattacacgcgccatcgctgaccaggcgagaacaatccgtatcccggttcacatggtggaaaccattaataaattaatccgggtgcagcgtcagcttcttcaggatcttggcagagagccgacaccggaagagattgctgaagacatggatcttacgcctgaaaaagtccgtgaaatattaaaaattgctcaagagccagtttctttagaaacaccgatcggtgaagaagacgactcacatctcggtgattttatcgaagaccaggaagcgacatctccgtcggatcatgcggcatatgagcttttaaaagaacagctggaagatgtgctggatacgttgacagatcgtgaagaaaacgtgctgcgtctccgtttcggtctggatgacggacgcacaagaactttggaagaagtcggcaaagtgtttggagtaacgagagagcgtattcgccaaattgaagcaaaagcgcttcgcaaattgagacatccgagcagaagcaagcgtctgaaggattttctcgaatagaatggaacgggtctttttgatccgttcttttttatgtataagatatatggataatatacctttattttactggataagcatatgttttgcaaatgagtttggaaaaaatgcggcatgtcctgaaaggggggaaatgagacaagtttatttatattctttattgtaagcgtatacaattcattatacaatagaataaagataattttgtggtaagcaaaacagttatttttgctttttgtataaattgtgaaatcattgaaattgctgagcaagaccatttactttttgtaaaaataagttagaattagaagtgtttacataggggagaatgaaaaagggggatggagatatgaagtggaatccgctgattccttttttgctcattgcagtgctgggaatagggctgactttctttttagctgtaaaaggcaatggagatgcgcatcagatcgcaagcggcggtgaaagcaaaaatgccgagaaggaaactgcaaacgcttcacctgaagagatttataaagccaactgcatcacctgtcacggagaaaactatgaaggtgtgtcagggccgaacttaaaaggcgtcggcaaaagaaaagatgtcgctgagattaaaacaaaaattgaaaaaggcggcaacgggatgcccgcgggccttgtgccggccgaaaagctggatgacatggcaaaatgggtttctgacattaaataaagctttaccggtccctatataaaagacatatgaaaaactctatccgccgcttggattccgggcggtttttttatatgatagtaaaggaaaaagaacctgagaaaagttgtgatattgtgaatgaaatgaagttatcgaaaagattgcagtctgtggcggaatatatccctccgggtgccctggttgctgatatcgggtcagaccacgcgtatcttccttgctatgccgttttgaatcatttggcaagccgggcaatcgccggtgaaattacagacggaccgtttctatccgccaaacagcaggtggaaaaactgcacttaagcactcttatctccgtaaggaaaggtgacgggctgagcgtccttgaaaaaggagaagccggcgccattacgatcgctggcatgggcggagcgctgatcgctcatattttggagtcgggaaaaacgaaattgacagggcgtgaacggctgattctgcagccgaatattcatgccgttcatataagagagtggctgtatcaggaaggctatgaactgcttgatgaagtgattctcgaagaagacggaaagtgttatgaaatcctcgttgcggaaactggcgaccgtgatgcgccttatcgggatgtgccgatggctgtcggaatgcttgcgggtccgtttttgttaaaagagaggaatgaagtgtttcttcggaaatggagccaggaacttaagcatactgaacaaatttatgaacagatcagccgcagcgcaaagcatgaaaatcatgaaaaattagctgaattgaaagagcggatttctctgctgaaggaggtaatcggacatgcctaaacatgtgaacggacaggaaatcatccagctgtttgaacaattttcaccgaaggcttatgcggtggaaggagataaaatcggactgcagatcggtacattgaataagccggtgaaaaatgtcatggtgacactggatgttttggaacaaacggtagatgaagccattgagaaaaaagttgacttaattatcgcccaccatccgccgatttttcggccgcttaaacagatcaccactgatcagccgggcggaagactgattgagaaatgtataaagcatgatattgccgtatatgcggctcatacgaatcttgatgtagcggacggcggtgttaacgatctgcttgccgaagctctcggcctgacagacactgaagtgctcgtcccgacatattcggacccgatgaaaaaacttgccgtatatgttccgaaagactatgaagaagctgtaagaaccgcactcggcaacgccggagcgggacatatcggcaattacagccattgcgcgttctcttctgagggaatcgggagctttaagccgctggacggggcagacccgtttatcggacagacgggagagctggaactcgtccatgaagtgagacttgagaccgtttttccggcaagtatggagaaaaccgtcgtaaaagcgctgaaaaaaagccatccgtatgaagaggtggcatatgatatttatccggtggagcagtctccgcttgaaaaaggcctcggccggatcggaaaacttcagcaggacatgacgcttgaagagtttgctctgtttgtgaaagaaaagtttgacgttaacggagtccggatggtcggagagcgaaacagcaaggtgaaaaaggtcgcggttcttggcggcgacggaaataaatatatttatcaggcaaagcggaaaggtgcagatgtttacgtgacgggcgacctttattttcatgtagcgcatgatgcgatgatgatgggattaaacgtcgtggacccggggcattatgctgaaaagatcatgagaaaaggcacggctgagaagcttacggcaatggccggagagaaaaactatgacgtgcgcattttcgcttccgaaacagatacaaacccatttaccttcttataaaaaaactgaggccccgggcctcagttttttatttttactttcggaagaatttttttgagcggcacactgtgttcaagctgccatgtcgattcatcgttgtggtcaaactgctctaaaaagcggatgacttcctttgtaatcggtgtcggtgttgatgcgcctgcggtaacggcgacggtattgacgtctttcagccattcgagcttcagttcactgatgtctccgattcggtaggcttttgttccggcgatttcttctgacacttgagccagcctgttggagttattgcttttcggatcgccgacaacaatggttaagtccgctttttttgcctgctctgatacagcttcttgacgaacctgtgtggccaggcagatttcctgatggtattccacgtgcgggtacttttctttgactgattccataatatcgtggacgtcccactgggacattgtcgtttggtttgtaacgattaatttctcagcctgaatatcgagatttctgacgtcttcttctgtttcaacgagatgaacgatttcaggagcgacgccgacggctccttcaggctcggggtggccttttttgccgatgtatatgacatgatagccttcagcttttacttttcggattaagtcatgtgttttcgtgacgtccgggcatgtggcatcaatcgtaacaagccctttttcctcagcggcttttcttacttccggagataccccgtgagccgtgaaaataacggttcctttttccacctgctttaaaatctccagacggtttgtgccgtcaagcgtgtaaatgccgtcttcctcaaacgcatctgtgacatgcttattatgaacaatcattccgagtatatatataggtcttggcagtgttttatcgagtgacgcgtttttggctatgaccatggcatcaacaacgccgtaacagtagccgcgcggcgatattttgataacgtccaatgtagatgtcctcctatcaaaagtgagtgtagaggcaatataaaaagccgtagttaaacggctcaaatcttgcattcttctgatctcattatagctaatctttcgtgagatatcaaagaatgttaaatatataatttcggctttgatctgcccgatgttctttttggacgcggctgttccgctgagtctgcctgtgcggcgtctttttcttttgaagcggatgctttttcagacgtcttctttgatgtgttggatgaggcgtctgatttgttttcatcttctgtttcatctgttttttcagcttcatcctttttatcctgttcgtttgtttcttttgtctcgtcagattcattctcatcatcgctgctgcttaattggctgtaaagcttcatcatggcgggcagactccgtactaaaggaccgtactgctgaatcatcggtgtaacctgctgcgccacgccgagcaccttctgaacgttgccgagcatgctcgacagggatgccggacttgccaggttctgtattccctgcagtcctgcacctgctcctccgctggccgccgccggtgccgacgcggcagcgcttcctcctcctgaaccgggtaaaaaacgggaaagcatcccttttaagccccctccgccgcccgtgcctgcgtttctcaggcccgctccggcaatctgctgctgagggaaaagctgccggccctgctgcatcagctgccggcccggcaatgacggtcttcctcccatcatcatacgcggattcatcaacggccggccctgctgcgccatatttctcatcggctgctgtggaaacatacttgtacctcctttctgtctctctgctattacaatatgcatcggagggggcatttgcttttctgtctcgaaaacaggattcccccaagacatggtgtttttaagtaaaatcggttataatgtgatgatggacacagaatgtgccgctttaaggagctgggaaaaatgaaagaaactaaatttgatggatacaacttaaaaccgtttattatagatgcagttcaccgccttggtttttatgaaccgacagatattcaaaagcggctgatacccgccgtgctgaaaaacgaaagcgtgatcgggcagtcccagacggggacggggaaaacccacgcctatttattgccaattttgaatcggattgatccgggttctgatacggtgcaggctgttatcacggcgccgacgagagagcttgccaatcagattcatcaggaagcgctcaaaatcacacagggtgcggaagatgagccgatccggacaaaatgtttcatcggagggacggacaagcaaaaatcaattgataagctgaaaacacagcctcatctcgtcgtcggaacgccgggccggatcgcggatctgattaaggcgcaggcattgaacgtctataaagcgcagtctctcgtcattgacgaagcagatctgatgcttgacatgggctttttagaagatgttgattatatcggatcgcggatgccggaagaacttcagatgcttgtgttctcagctacgattccggaaaagctgaagccgtttttgaaaaagtatatggaaaatccgaagtacgcgcatgttgagccgaaaagaatcacagccgaaaagattgaacatgttttggttccttctaaacagcgtgataaagacaagctgctttttgatatgatgtctcatctgaatccttatctgggcattgtgtttgccaatacgaaaaacacggctgaccatattgcgaaatacctgactgaaaagggcatgaggatcggtcttctgcatgggggattaacgccgcgtgagcgtaagaaggtaatgaagcagattaatgatctggaattcacttatgtcattgcgacagaccttgcggcaagaggaattgacattaaaggcgtaagccatgtcatcaactatgagcttccggacgatctggatttttatgttcaccgcgtcgggagaaccgcacgcgccggttcatcaggccaagcactgaccatttatgagctttctgacgaagatgcgctcgtaagactcgaaaagatgggtattgtgtttgactatgcggagcttgtaaacggcgaatggaagaaaggcgatgaccgccaccgccgcaaaaaacgcaaaaaatcggagaatgaggccgaccaaatggcgaagcgcctcgtgaaaaaaccgaaaaaagtgaagccgggctataaaaagaaaatgagctacgaaatggaaaagataaaaagaaagcagagaagaaacaaatctaacaaaggaaagtaggggactcgggttgctgaaaataggttcacacgtctcaatgagcggaaaacatatgctccttgccgcaagcaaggaagctgtttcgtacggggcgaatacatttatgatctatacgggcgctccccaaaacacgcgccgcaaaaaaattgaagacttgaatatcgaagcgggccgcgcccatatgaaggaaaacggcatcgatgagattgtcgtgcatgcgccgtacatcattaacatcggaaatactacaaatccggcaacgtttgagctgggtgttgattttctgcgttctgaaattgaaagaacggcagcaatcggcgcgaaacagatcgtgcttcatccgggagcgcatgtcggagccggggctgagacgggcatcaaaaaaatcattgaaggtttaaacgaagtgattgttcccggtcaaaacgtgcagattgcgctggaaacaatggcgggcaaaggatcagaatgcggaagaagctttgaagagctggccgagatcattgcggggttacgcataatgaacatctatccgtctgctttgacacttgccacacccatgacgccgggtatgatgtcgccaatgattttgacggtgttcttaacgagtttgataaaatcgtcggcatcgatcggataaaagtccttcatgtgaatgacagtaaaaatattaaaggcgcccggaaagaccgccatgaaaatatcgggttcggagagatcggttttgacgctctgcagtacatcgttcatcacgagcagcttgccgatattccgaaaatcctcgaaacaccgtatgtaggcgaagacaagaaaaataagaagccgccgtaccgttttgaaatcgaaatgctgaaagaaaagcagtttgatcaggagcttcttgaaaaaatatcagctcaataaaaaaggagggggaattgccccctccttttttaccctgagaattggttgaaaagttcgtcaactttccgagctgtttcttttgaggttatcgtttctacttttttcagcaggcgaagccgctcctgttcatcaaaaatattgatgttttttccgtgcatcagagccgctacctcagccgcttgacttctcgtaatgctgattccgtattgcttggaatatttcagaagatcgtccgcagtgacttgattgagccgctgcaaaataattctttgtattaaaatcatcgatactttcacctctttagacataatgtattgagcaaatcattaaaatgttacggcttttaatggtaaaatgaagttgcttactgtttaaaatagttattacaggaaaggagattttatgaccccaaataaacagcataaaagagagtcatttttacactttatcttcagggtcattatgattctgatcggggcgggttcagccgctgtaagtattgaattgtttctggtccctaataattttatcgacggaggcattatcggtgtttcattaattttagaccacctctttatgtccaatcccctcctcaatttcgccttattcgttgtgttactcaacattccatttatgattttcggatataaatatatcggaaaaacatttctcatctctactgttatcggaattgtcggtttagcgctgattgaatcctccttgcaccatgtggaggccattacgacccagcctattttggcgacggtattcggcgggcttttgctcggtttcggggtaggccttgtcatccgaaacggaggctcgatggacggtactgaaatactcggtatccttctcacaaaaaagctgcccttctcagtcggagaattcgttatgctcatcaatgtgtttatttttatttgggccggttttgtgttcggtccggagcaggcgatgtattctttcatgacttattatattgccatgaaaacgattgacgccgtcatccaggggcttgatgaaacaaaagcggtcattattgtggcagatcagtatgcggaaatttcagacgcaatcttgcatcggcttggaaggggaaccaccaagcttcagggaaaaggcggatatacggatgaatccaaagaagtcatttacgcggtcgtgacaaggcttgaagtgactaaattgaaatccattgtgtttgaaattgataaaaacgcctttattacgatcatgaatacccatgaaacgaggggcggtaagttcaaaaccgcgattcactaggctttcatttacttttcatcattttataggtataatttgatacatcataagaaaatggcctgctgttcagacagctgccattttctttttggagcgataccgtgttgtaaaggggaggtcctcatgaacgtacaagaagcgttgaacctgctgaaagaaaaagggtataaatatacgagtaagcgagaagacatgctgcagctttttgctgattctgataaatatctgaccgccaaaaacgtgcttgccgcattaaatgacgactatccgggtctgagttttgataccatataccgaaatctttcgttatatgaagaactcggcattttggaaacgacggagctttccggagaaaaactgttccgttttacatgctcttatacccatcatcatcaccattttatctgtttaacctgcgggaaaacgaaggaaattgagtcctgtccgatggataagctgcacgatgatttggaagggtatgaaatcagcggccataagtttgaaatttacggcacctgtccggcgtgccgataaaaaacctcctgctatatacaggaggtttttttcagcttttaacatgctgaaagctgtgtttgtttttattaatccaggcgacggcttcaagccaattatgcaccctgataatattggaatcgatggggagctgattatatggggagttaaaaaggataaccggaatgcctgcttcttttgcgatcattgtcgcgttgccgtggtgatcttcgaaaaataaatcaatgccgtgttttttgacggcttccactttgtgatggcctccgacaagctcaatgtgatcgtaatgaatgtcccggtttgcaaaccagtccagcgtaacatcttctaagtggccgcgtcttgccgtaatgtagataagacggtgctcttctttcagtccgtccagtgcctgcttggcaaattccgcgagcttcgcttctttatatatggctgcttcatgaacgttcatccattcccaaaattcctcgtctgtaatgttcaaaagcttcgtcagatcataatcagtcatatcatccaaggtaatggaaagatgaaatgagcggtttaaataagggacaaatgtatcctgtgccgtaactgtgccgtcaatatctatacctaaccgtaacatgtccacactcctataaattcatcccttcaagtgtaacataaacaattaacaataccagaaaagtttagcaaacatgaatccgtaaaaaacgcggaaactaaaaaagctcctttcataaaagaaaaagggggaattgaaggtggcatacgattacgaaaatcgaaaaggcaacgactattacgtggatcatggatcggaaggaaccgatatcacgcgtgatgtttattcagaagaaacagcggccgaaatctcagagccatatcgtgcttctgaccgggcagcagaccgtgatgataatcgggacggagtaagtgaaggccggggatagggtatgcagcattggctatttctatcatttccctgtttgtgctccctgttttattaggggcatgcggcattatcgtcggctatatcgccagaagaagaggagcaggcgctttaggcggatgggcgatgggaatcggtattgtttcccttgtgcttggcatcttcattacaccgtttttttaacacaacgcaaaaaaaaagcttggcggaatatccgtcaagctttttgtgtttcttgttctgcttttgctttttctgcttcaagctttgcatagtgttcttctgccagcttgtcgatttcttttttgagctcttcgaccattgtttcttcagggactttgcggacgatttggcctttgcggaaaagaagtccttcgccgcgtgcgccggcaatcccgatatcagcttctcttgcttcgcccggtccgttaacggcacatccgagaaccgctactttaatcggcgctttgactttagaaatgtattcttccacttcatttgcgatgctgatgagatcaatttcgatccgtccgcatgtcgggcatgaaataagcgtagccgcgtttgaagcaagaccgaatgatttcagcagttctctggctacttttacttcttcaacaggatcggcgctcagagagatccggagcgtgttaccgattcctttgcttaaaatcgctccgagtccggccgcgctttttaccgttccggcaaacagcgtgcccgattctgtaattccgaggtgaagcggataatcaaatgcttttgacgctttttcgtatgcttctatggcgagattgacgtcagacgctttcatactgacgatgatgtcatgaaagtcaaggtcttccaggattttgatatgatgaagcgcactctcaaccattccgtcagcagtcggatagccgtatttttctaaaatgcgcttttccaaagatcccgcgtttacgccgatccggatcggaattcctttttctttcgccgcttttacgacggcttccactttttcgcgacggccgatgtttcccggattgattctgattttgtcggccccgccctcaattgcttttaatgcaagcttgtagtcaaaatgaatatcgacaacgagagggatggaaatttgttttttgatgtcggcaatcgcgttagcggcgcgttcgtccggacatgccacccggacaatttggcagccggcttcggctaaacggttgatttccgcaactgttgcttctacgtcgtgtgttttggtcgtcgtcatactctgaatgacgacttcgttatttccgcctattgttaaaggtcccactttgacgggacgcgtttttgtacgatgtgtgatttcactcacttgtcaatcgctccttaattgtagttaccgcttttgcaggctgagccttttacatgtcaggcaacttctatttacatgttatattgtaacagtgtatttgccgaactgacaagaaattaacgtttaattgcggtagacggggaatttataagcggtgcctgcctgaatggcgtttgcttttacattcggattcagcgcttcaaaatcttgtgcaatatcatctggcgctttatgtgcgccgactatcgacatcaccgtatcgccttttttgaccgtaaccgttctgtatgaagcttcctgttgggctggctgtgccgccgctgcgtatgctggaaggtcttgagaagggatcgtgccgattttaagatcgtaaaagataatgaatatcacaaataaactgccgaatacaaaagtaagccgcttcattccaaccgcctcccgcatacatttttacttcattgtatgcttgtcccattttgttcatgacaaaaaagaagaccgccgggggcagtctttgttatacatctgttttacttcgcggtatctcttttaagacgaggaaaaggatgataaagtttacaaaccaattcactaaaaattcactcggcaccgtaataacaagcgcgcgcatgatcgtaaagaatacggtcgaaagtgtaatggaataagccgaaagcttccagagctgctggtaattcaatgtctttctttgcgcatttttcaatatcaggccgatgacggcgagaaatgatacttcaatgaatttgcctgccgctgtcatgatgaacagcaaaacggacaggacggtgacgatcattgttttattttggtttaatgctgatatgatttctttttttgtgatatcggcaggcatcagcgaataattcatttctgtcgcttgtccgtctacagcaagcaccattttatttttcaaaatgccgatcgcattttgtttcgccgctatttgtttcgcgccgtaagcatctgtgggatcaaagacgatgacgaacccgttcgcttccgtttccttagaggcggacgctttcgtctgcaattctccgtttgaaatgctgaaatcagggaaatctttctttaacacggttttgaaaccgttcattgagtttacggtgccggagcaaaggtaataagcgcttggcagcgtaaaaaggacagacagcaaaaatacataaaggatcgcttttcctatcccctgaaaccgtgtttttgcaatatctgccggagagtatgtacttttcaataaagccgtaaatatgttcaacatcttcacttcctagcctaaactggtatatgttgcttattgtatcgttcacaggggatgaacacaagtgagagtatttaaagcggtgataaggaatcatacataataagataaagcgggaagcggtgatcgcccgcaaaacaaaggagggtgtttttgtcatgagtgttttgtattggctgattatcattgcggtcttcatcattgcttttatcgggcttgtatatccggtgattccaagcgttatttttattgtggccggttttcttctctacggatttttgttttccttcagtccttattcttacctgttttggctcattgaggcggtatttgcggccgttttattcgcagctgattatgtgtcaaatttacttggcgttaaaaggtacggaggaagcagggcggcaatctggggaagcacgatcggattattgatcgggcccttcgttattcccgtggcaggcattatattagggccgtttatcggtgctgtctgcgctgaggtgtttgttcatcaaaaggatatcaagtccgcggcaaaagtggggctcggctcgttaatcggttttttaacaagcgtggcggcaaaaggcgtcattcagctctttatgatcggatatttcttatggacggtgctttagaaaggtttaatttcggcagggaacggataaagtgtaatatgtctgctggaatcgccggattgtgagctttttcattgattaccatgctttcttttgttacattgagattagaaaagttcgcgttaagcggcatttcagtacatatatttaaaggaggaaaaaaattatggcttacaaacttccagaattgccttacgcttatgatgctttagaacctcatatcgataaggaaacgatgacgattcatcatacgaagcaccataacacatacgtgacaaacctcaacaaagcgatcgaaggatcagcgcttgcagagaaatctgtagatgagcttgttgctgatttgaacgcagtgccggaggacatccgcacagctgtccgcaacaatggcggcggacatgccaaccactctttattctggactcttttatctccgaacggcggaggcgaaccgactggtgagcttgctgaagagatcaaaaacacgttcggaagcttcgatcaatttaaagaaaaattcgccgcagcagctgccggccgtttcggttcaggctgggcttggcttgttgtaaacaacggcaaacttgaaattacaagcacgccaaaccaagattcaccgctttcagagggtaaaacacctgtcctcggtcttgatgtttgggagcatgcgtactacctgaactaccaaaaccgccgtcctgattacatttcagctttctggaatgttgtgaactgggatgaagttgcccgtctttacagcgaagcaaaataaatagttcgatcaaacaaggtctcccgcgggaggccttgtttttttattgactttgaatccttttacatatctcagtttgagtgagacaaactaatgtgtagtaaaggggagtcaatgatgagcaaaataaaaaaaattatcggcgacatcgaaataaataaagggctgctgctgttattgacgattggcggcctttactcattgggcatcgcgctgtcaaatacatttgtcaacgtgtatttgtggaagcagtcgggaaaatttattgatttggccatatacaatttgtcggtcgtaacgatgcagccggttacctttctgctggccggccggctggctaaaaaaattgacagggtgtttattctcaggttcggcgttatctttttggccgctttttatttaagtgtgctgcttgctggagaaactgcggcttcccgtctcgttttgataggggccgtgctcggagttggatacggcttttactggctggcttttaatgtgctgacgttcgaaattacggaaccggaaacgagagatttttttaacgggtttttaggcattttgtcttcatcggcgggcatgatcggtccgattgtggccggatatgtcatttcaagacttgaaaacaatacgggttatacaatcattttcagcctgtcgctcggcttatttgcccttgccgtggtcatgagcttttttctgaagcggagggagtcgaaaggccggtttatgctgaaaaaagtttttgatgagcgccacacgaatctgaattggcgccggattaccaacgcgcacttttttcaaggcttgagagaagggatttttgtttttttaatcagcgtttttgtattcattgcgacaaacagtgagctggcgctcggaacattcggtctcgtcaattccgcggtttctttttttgcctattattttgcatcaaggctcatcaaaaaaagagctcggaaaaaggcgattcttatcggcggattgatcttgtacggtgccctgtttcttatcatttttaaaatgagcttcacgacgctccttttgtacggagtgtttattgcgatcggctatccagttctgctcgtgccgtatgtctcgcttacatatgatgtgataggccgggcgcggcttgccagaaaagccagaattgaatacattgtgctcagggagttatttttaaatgcgggcaggatcgtttccatcctttgtttccttgtaatcgttacattattcaaggaaaaagtgggaataccggcggcgctcgtgctgctcggagccggccatccgctgatttattactttataaaagacatcagactggatacggaaacttctgatgaaacagtagaagaagaccgacaaaaacaggcggcggaaccgaattttataaaaggagaaagataaaagggttatctgtagaaaaatatcgaaaaaacctttagaatgaaaaatgacacctgaacagaaggtgtcatttctttctgtaaataagaaaaggtgatgtcatgaggagaaataaaaagaaaatagctgtaaacaaagaaaagaaaaaatcactgccgatccggcttaattttttgtttttggccgcgtttcttattttcacttggattatcgtcgagcttggcatcaagcagatcgttcagggtgatgattataaaaacgccgctaataagcaggaggagtctgatgtcagcacggcggttccgagagggaaaatatacgaccggaacctaaatcccatcgtaacgaataaagcattaaatgcgattacatatacacgttcagcctcaaccacccaggcgcagcgtttaaaaatcgcaaaaaaactgtcgggtatgattaaggtaagcaccaaaaaggtgactgagcgggataaaaaagactattggatgttaacgaggcctgatgaagcgaaaaaactgattacggccgaagaaaagcaaaaagctgaagacaaaaaactgtctgaagatgatttatatcagcttcagctgaaacgtatcacagacaaacagctgaatgagctcacttcaaaagatatgcagatccttgcgatcaaaaggcagatggattcaggctactcactgacgcctcaatacatcaaaaatgaaggggtgtcggcaaaagaaatggccgtcgtcagcgaacatttagatgaactgccgggagttgacgtgacgtctgactgggaacggtcttatccttataaaagcctgatccggacattgctcggcagtgtatccagtgcgaacgaaggtcttccttccaatctgctggatcactatctgtcactcggctacagccggaatgacagggtcggaaaaagctatttagaatatcaatatgaaagcctgctgcagggtcaaaaagagaaagtgcagaacttaaccgactcatccggaaatgtcacgggcagcaaagtgatttcaaaaggacaggccggcaaagaccttgtattatccattgatatggacctgcagaaatccgttgaaaaaatcattgagaaaaatttaagatcggcaaaagcgagaccgagcacgaagcttcttgatcgggccttcgtcgtcatgatgaacccgaaaaacggagaagtgctgacgatggccggcaaacagattacgaatgatcatggaaagtacaaaattaatgattatgccctcggcgcaatgacttcctcctacgcaatgggatcggcggtcaaaggagcgacggtgttgaccggactgcagacgggcgcgattaatttgaacaccgttttccaggatgaacctatgtatttcaagggaagtaaaaacccgaaaaaatcatggaccaatttaggtcccgtagatatccaaaaagcgcttcaggaatcctcaaacgtgttcatgttcaaaacggcgattgctgtcggtaaaggggagtacaaaaaaggccagtcccttccgcttgatatgaaggcattcgatactttcagatactacttcaatcagttcggactcggagttaagactgggattgatcttccgaatgaagcaaccgggtaccaagggacacagcgaatttccggtcttctgttagactttgccatcgggcagtatgatacgtttacaccgctgcaaatggcgcagtatgtatcaacgatcgccaatggaggctatcgtttgaaacctcagcttgtaaaagaggtcagacagcctgattcgaaaaaaggaatcggagccgttgtagagtctgttcagccccaagtactgaacaagattgatatgaatcatgcagacattaaagaagtgcaggcaggtttcagacgtgtcatgacaaaagggacagccgcaactgattttgcgacggcgacatacagtcctgccggtaaaacgggtacggcgcaatctttctatgacggtcctgacaaatcagagacgggtgaaggaacgtataatacgactcttgtcgcgtatgcacctgctgataatccggaagtggctatttctgtagtcgttccttgggcctatattaattacagcgatcgatattcgattacgaatgatataggaagagcagctctggacaaatactttgagctgaaaaagaaacaagaagataataatacgaagcagaaaaacgaagataaaattcaggaagacgctgaaaacggcaatacaagcaactaacagaaaaacgctcacaacctgtgagcgttttttttatacaaaaaaacatccggatttacaaaaccttaacacttgatttatacgcattttacaagaaccctttactctatacgtgtaggacaaattacacattaaatgcagggggaattcaggaaatgaaaaaaaacaaatggatgcttatgcttctgatggctgctgttatgattgttgctgcagcatgcggaaatgcaaaggaaagcggcaagacagacagtcaatctgcaagtgaggataaaaaagcatcaggttctttaaccatttctggttcatcagccatgcagccgttagtactggcagcggcggaaaagtttatggaaaaacatccggatgctgatgtgcaggtgcaagcgggaggttcaggaacaggactttcgcaagtgtctgaaggggcagtgcaaatcggcaactcagatgtcttcgctgaagaaaaagaaggcattgatgcgaaagccctaaaagaccaccgagtagcggtagtggcgatggcggctgcggtcaaccccggtgcgggcgtaaaggatataaccaaaaaacagctgacagacgtctttacaggtaaaattaaaaactggaaagagcttggcggtaaagatcaaaaaattacactcgtgaaccgtcctgattcatctggaacacgcgctacgttcgtcaaatatgctcttgacggagcagagcctgcagagggcattacagaggattcctccaatacagtcaaaaaaatcattgcggaaacgccgggagcaatcggttatctggcattctcttatataaacgatgacaaagtaacgcctttatcgatcggaggcatcaaaccggaagagaaaaacgtcgtcacaggcgagtatccgatttgggcttacgagcactcttatacgaaaggtgaagcgtcaggccttacaaaaacgtttcttgactatatgaacagcgatgaagtacagaaaagtatcgtaaaagatcagggctacattccgatctctgatatgaaagtcacacgtgacgcaaacggcaagcaaagctgaggggagggcgggctccccgcctcttcttctttataggagtgtaaacaaatgataaatcacagagaaaaagagtctgtaagcgaacgcttaataagctcaaaacaaaacaggcaattggatgaagtccgcggaagggtgattgtgtctgtgtgtgccgcgattatcattgcggcatcagcggcgatcacaatttttctcggcataaaggggctgcaatctttttttgtaaatggtgtaagcccgattgagttcttaacaagtctgaattggaatccaacccaggcaaaacctgagttcggcgcgctgccttttattttcggatcatttgcggtcacgattctgtccgctctgatcgcagcgcccctcggtattgcgggtgccgtgtttatgacggaaattgcgccgacttggggaaaaaaggtgctgcagccggtaattgagctgcttgtcggcattccgtccgtcgtttatggattcataggtcttacagtattggttccgtttatcggctcttttaaatcaagcggaacgggtcacagccttctggcggggacgatcgtactctcggtaatgattctgccgactgttacatcgatttccgctgatgcgcttgcgtcacttccgaaacaccttcgcgacggttcatatgcgcttggggcgacgaggtggcagacaatcagaaaggtgcttatcccggcggcgtttccgacattgctgaccgctgtcgtgctcgggatggcaagagcgttcggagaagcactcgccgtacagatggttatcggaaatacaaagcttctgccggaaagcctgcttgatacggcgggaacattaacgacgattatcacgttaaacatgggccataccacatacggcagtattgaaaataatacgttatggtctatggggcttgttcttctcatcatgtcgtttctgtttatattgctcatacgctacttgtcatctaggaggaaagtgtaatgaaccggaaaataacggataaattggccaccggtgtattcgggttatgcgccgctgtaatcgcggcgattttggcaggattgtttttgtacattcttattcacggcgtctctgaaatctccttgcgttttcttacgtcaaaatcgagcgccattgcctcaggcggcggaatacgggatcagctttttaactccttttacattctgtttatcaccatgctgatcacgataccgcttggtgtggggggcggcgtctttatggctgaatatgcgccccaaaataaaatcaccgattttatcagaacgtgtattgaggtgctgtcttcgcttccgtccattgtcatcgggatgttcggcatgctgatgtttgtaaacctgaccggatggggctacacgattatcgggggcgcgctcgcattaacggtctttaaccttcccgttatggtccgggtgacagaaggcgcgctcactgcagtccctaaggagctgaaagaagcttctctcgctttaggcgtatcgagatggcataccgtcaaaacggtgctgattccgagtgcgattccttcaattttaaccggagccattctggcatcaggaagagtattcggagaagcggccgcattgttatttacagcggggctgacaacgccgcggctgaactttacggatttgaacccattttctgaatcatctcctttcaacattttcaggccggctgagacgctggcggttcatatatggagtgtcaatacgcagggaatcatccctgacgccgaagcgattgcaaacggcggctcggcggtgctggtgatttcggttctcttgtttaacctttctgcgagatggctcgggtctgtcatttataaaaagcttacggcaaattaatcggaaagaggcgaaaacatgatcgatcacatcatcagggaacaagcggaacagacaaagcgtttgccggagtcttcgattttggaagtgaagcatttatcaatttattacggtgacaaacaagcggtaaaagatgtaaacatgaatattgaaaaacatgcggtgacggctctgatcggtccgtcaggctgcgggaaatcaacatttttgagacagattaacagaatgaacgatgccattgcttcggcaagaagcgagggagagatcctttatgaagggctgaatattttgggtgaagcgattaatgtcgtgtctctcagacgggaaatcggtatggtgtttcaaaaaccgaatccgttcccgaaatccatttacaataacatcacacatgcgctgaagtatgcgggggaacgcaggaaagccgttttggatgaggcggtcgaggaaagcttaacgaaggcggcgctttgggatgaagtcaaagaccggcttcattcatcggctctgtcgttatcaggcggccagcagcagcgcctttgtatcgcccgtacgctggcgatgaaacctgccgtgcttcttttagatgaaccggcttcagctctggaccctatttcaaacgccagaatcgagacgcttttgacagaactgaaaaaagattattcgattattatcgttacgcataacatgcagcaggcgctgagggtgtctgaccgaacggctttctttttaaacggggaagtggtggaatacgggcagacagaacaaattttcacgagtcctaaagcgcaaaagacagatgactacattaacggaaagttcggatagggggaaggactgtgagtcttgtgaaggaagcggtgcacacacagaatttatttgatattcacggcatgaacgtatggtacggagcccatcaggctttaaaagacattacgatcggttttgaggagcggaaggtaactgcgatcatcggtccgtccggctgcgggaaatccacttttattaaaacattaaacttaatgctgcaaatggccccgaatgtcaaagtgacaggcgacatgatctataacgggcgcaatctgctgaaggaaaagacggatgcggcagaattaagaaaacagatcggtatggtgtttcaaaaaggcaatccgtttccccagtcaatatttgagaatgtcgtgtacggtccgagaattcacggcgaaaaaaataaaaagaaactgcttgaaatcgccgaggaatctttaaaagcagctgcgctctgggatgaagtgaaggatcgccttcaccaacaggcgctttcactgtcaggcggtcagcagcagcggctgtgcatcgcaagagcgctcgccaccaaaccggacgtccttctgatggatgaaccgacgtccgctcttgatcccgtgtccacgcggaaaatagaagagctgattttgacattgaaagaaaagtatacaatcgtcattgtgactcataacatgcagcaggctgcgagggtctctgatcaaaccgcgtttttctatatgggcgaactggtggagtggggcgatacgggcaaaatattttctcagccggatcatcaaaaaacacatgattatatcaccggaaaattcggatgaaaaaaacgggcccggccattaaccgggtccgttttatatgtctattaaaaaagcctgccggccgtatccatctgaatggacgatgcctgcaagcttttttagcgggttaatgttttgacgatttttttaaagctcatatctgaatcgactttgaaatggccggcgcggatttctttgtggtagcctgcgtcaatgacgtaatcattgaagtctttcgctgaaggaataatcccttctttttcaagaatggatgacacatcagcagtgctcattccgtctttaatcgtcagtttgtatgttacttttttctttttggcgtctgtgttttggtcgttgtttaacgatttttctttagaatcaagcagtttttgatagtcatcccggttgacggagactttatgctgatcgtcgaggtagctgtttacttctttttctgtcaatgctgttttttcggttttaacggcggctgcctggtcatggtcagtcaaatagaagacagcggcgagaacggccgtcgctaaaatcatgcctgctgcaaaagcctgaatgccccgttttgtcatacgagcaccttctcattatctttaataatggtattgacgtcctcgacagacacgtgctccgcttttgcgatggcttccgcagacattccgttgttatattttgaaatgatttgtttggcgattttttggtttatgccgctgcttttggctttgcggatcacgaggttggtttccagcaattcttcttcaagcaccgtcattttctttttcaacttgtaaatttcctgcatggcggaaagctgaagcgtttctagctcctgttccacgtctttcatcggatctctttgagaatatgagaatgcaataagcgctatactgacgataaacaacgcaataatagcaatttccacgtttcatcaccttctattattaatttgcccttcttttttataccataaaacgccgccattctaaaggaaatagagaaaaaaacggaattttgtcggaaaatcttttttactcggggagcaaacggttatttctctatagatttcgtatcagaaagcccttttttgtcctgtttcgtcatattttaccttcttctgacgcaagctcattcagaggatcagaagcgtaaactgatgttttctgcacttaaacaacatttcatgtaaatcagctctagcattccgtccattatagtggtattatatataagtctgaataagtaaatgatatttagtttggagggaaaataatgcgcgttaatattactttggcttgcactgaatgtggtgagcgtaactatatttctaaaaagaacaaacgcaacaatccggaccgcgttgaatttaaaaaatattgcccacgtgataaaaaatctacgttacaccgtgaaacaaaataagctgtttaacacagcggaaaaagctggagctttcaataaagttctggcttttttgtctttcagggaggtttgagaaacgtgaaagcacaaatcagaaccgatataaaagcaaagctttctgacatgacagaaagtgaatgggagaaaaaatgccgcagcatgcgtgaaacgctgttttctttaaaagaatggagacaggcccgcgtgatcgccgttaccatctcgacacgcctggaaattccgacacggccgattattgaacaggcctggcaagagaaaaaacaagtctgtatcccaaaatgctttccgcagacgggagcaatggagttccgtacattttctgcgtatgatcagctggaaaccgtatatgcgggcctcagcgaaccgatcgagagtctgacggaaaaagccgcccaaaatgacattgaccttgtgattgtgcccggcgtggcttttgaccgggaaggcttcagaatcggatacggcggaggatattatgatcggtacctgtccggttataaaggccgtaccgtgtcgcttctctttgactgccagctgacagaccgcattccccgcatgccccacgatattccggtcgatatgatcgtgactgaatctgaaaccatcgcttaatcgcataaaaaactttttgcaccggaataattctcgctgtttgacaaacgataggggcaggagggataagatgaaaaaattgttgatctactcattatgcgccgtatctgttttagccgtttaccaaaaccgctaccgtctgatgaacagcgtgctcagccagccggggatcagacggacattcattcatttctttttaaaaataccgtttatcagaaacaaattcattcagcaggcattttaaacaaatcccgttttttaagcgggattttttgcataagaaaacctgccggtaaaaaacggcaggttttctcgtattgtcagctttttttcaggaaaccgagcagaattgagattataggagaaatgtacaggaaaaaggtaaacggcaggtagtcgacgacggaaacccctaatgcgcttgccataaaagcgccgcttactccccagggaatcagcgggttgatcaaagttccgccgtcctcaagcgaccgcgcaaggtgaatccgcttaatgccgagcttgtcatataaaggtttataagattgacccggaattaagatcgacaaatactgctcacctgtcgcaaggtttacgcctatacttgagaagacggtcgccatgacaagacgtcctttcgtatgcacgccttttatcaatccttgaagcagcgccgcgatcaggcccgttttttccatcaggccgccgagcgcaaaggcgatcataatcagagagactgatcccatcatcgattggagcccgcctctgttgataatgctggccacagcctggtcgccggttttaaacgccgtcccgctttgcagggcggatataaatccttgaatgctgctgtcaggaataaaaacagcagtcagaagccctgcggaaataataccggcggtaagcaccggaatcacggaaacccgtctcacagctaaaatgatcactaacagaggtgaaagaagcgaccaaggcgtaacgtgcacggcctcttttattccggaaatgaccgcctcaatattttgcgttgaagcggcatttattgaaacagatgaaccgagaatataaaaaagaacgatcgtgatcagcagtgccggaacggtggtgcccatcatatggcgaatatgcttaaaaatcggaatttcgccgattccggcggcaaaattcgtcgtgtcggacatcggtgacattttatcaccgaaacaagctccgcaaataactgctcccgccgtccattcgagcggaactcccgccgcgcttgctacccctaacagcgcgacgccgattgtactgacagttgtcagacttgagccgacaagcgtgctgataatcatgcaggaaaataatgcggtcaaaagcagctgactcggctgtataattgacaaagcgtaaacggtgacggtgggaatggcgccgctgtacatccaggcgccgatcagcacaccgatcaaagccagcacgataatcggctgcaccccgttttttaatccgctgacaattcctttttcaagactctcccacgagaaaccgagccacaaacctgccagagacagaataatgacgcaaaagaacagcggcatatgcggctctgtatgaaagaaaaacaggcaggaaataatgactgctaacatcaagacaaataaactgatggctgagatgaacgtcagccttttttcttgtttcaaaacaacaccccatcaaactttaatccttttgtgcttttgggcacgaaagtattgtaacagaaaaacgcataaatgagtgtttttttacaattgtgaatatacaatttatgaaaataatacaaggatattttctccaatcgttttttgcttgacgcccggatcagtgatgaaatacgcttatactaagaagaatagaaatggtgaagaagatgaattcattttatgacgtgcagcagctgtttaagtcattcggacatattgtttatttcggtgacagacaagccgaaattgactttatgaaagatgaattaaaggaaatgtacttgtcaaacgtgattgaaagagatttatggcaaaaagccgccggagttcttcagagagaatcggagcggatcagaggcagttaacacagcaggattttaataagaaaaggagattattatggaagatacatggtttgcggggattgatctgggcggaacaaccatcaagctggcctttatcaacatgtacggtgaaattcagcataaatgggaagttccgaccgataaatccggaaacacaattacggtcacgatcgccaaagcgcttgatcagaagctggaagaactgaacaagccgaaacggattgtaaaatggatcggaatgggagcgcccggacctgtggaaatgacgacgggaatggtctatgagacgacaaatatggggtggaaaaactatccgctgaaagaccatctcgaggcggaaacgggtattccggccgtcattgaaaacgatgccaatatcgcggcgctcggagaaatgtggaagggtgcaggtgacggggccaaagatgtcattttagtgacgctcggaaccggagtcggcggaggcatcatcgtcaacggagaaatcgttcacggtaaaaacggggccggcggagaaatcggtcatatttgcagtattccggaaggaggagctccgtgcaattgcggaaaatccggctgcatcgaaacgattgcgtccgcaaccggcatcgtccgcatcgcgaaagaaaagcttgcggcggtttccgactcttcgctcttacaagtgcgcgatctgacggcacgtgacgtgttcgaagcggctaaacagcaggataagaccgcgcttgaagtcgtcgattatgtcgcaaaacatttaggcctcgtgctcggaaatctggcaagcgccatgaatccgacaaaaatcgtgctcggcggaggcgtgtctaaagcgggggaaatcctgcggtcaaaagtggaagagaccttcaaaatcaccgcgttcccgcgttctgcggaagcggccgatatttcgattgcggcacttggaaatgacgccggagtcatcggcggggcgtggattgccaaaaatgaatggctcaaacatcaaaactgctgaagaaagtctgcctgcccatatcgcgggcggctttctttttttatctcccctgtcatatagtttttaaaaaagggggatgaacatggcgggaattcgtgtcaaacctgaattgaaacagcatatgaaagatattgcaaaggtgctttcaattgatgaaaaactgttgaaagccgctgataaaacggcggaaagcgatgaattattttgtcccggctttgccgtgagcgggcagtcagagggtccgccgcttgagacgctgagcgggctttcgcgatacatccggcactgtgaaagcgttctttccgctgatcaatgggtgaaggaagaaaaggtgtacggctccgaatcggtttatgaagaaattgagaaaataacggatgtctttccgtttgtcacatgccgtaaaatcggcagttccgtattgggaaagccgctttatgagctgaaaataggtgcggatacggccgaaagaaaagtccatgtaaacgcctcatttcatgccaatgaatggatcaccacctcggtcgcgcttaaatggtgtaaagaatattccgtggcattatgcgaaaataaaaccgttttcgggcagtctgtgcttgatatattcagccggacatcattgtcattcgttccgctcgtaaatcccgacggtgttgatctcgtactttacggatgtgaagatttatcagaaaaaaaagaattcctcaacgaattaaatgagcaccgcccggatttccgcgaatggaaggcgaatataaacggtgtggatttaaataaacatttcccatccaattgggatattgaacaaaggcgcaaaccgaaagccccttcataccgtgattttccaggaacggcgccgctcactgaaccggaggcgcaggcgatgcaccggctgataacggaacagccacctgaccggctgatcgcgcttcatacgcagggagaagagatttactggggatacgaaggatgtgaaccggagcaatcatcccagatgattcgggagtttgaagcgataagcggaaaccgctatcaaggcgttaaaaccattgacagccatgccggttttagggattggtttatacagcagtatggaaaagagggctataccattgagctcgggaagggaaaaaaccctttgccttttcatcagtttgctgatatttatcaagcgacggaaggtattttgtggaggtcgcttgttttttgagacatctgtgaaatttctcatttgtttacataaacaaatatgggacaatagaaaagaatggagggaaggctgatgagatacttggtttgtgttctgctgtccgcattcgttctgtgtttagcggcctgtgaaccatctcatcagcagcaagacacaggcgtttcggcaaaatcggcagaacagaaaatcgttccgctcagtaaaaaggaagcggaaaaaacggaaggatggctggataacagaacaattctgtatacagcacatcatcagctgatgaaatatgatcttttcagcggaaaatccgaacggctctatgaaacaaagggcaatattgtcaatgtaaagatcagccggaaaaaacagctgattctcgtacaggtgacaagcagcggtcagactgagcttgtgcttatgaacaagcaggggaaaagactttatcacaaagcctttaactcttatgagctggagacggcttggaatccgtatgacccgtatcaaatgatgattaccgtttttactgaaacatgggacttcacagcctatacggccgatatgaacaacggcattttaaaaaagagtcccgttcaggccccttttgtccattggacctccactgatgaattccaatatatcaagcaaggaaaaacggaggaagagggtcctttatattcttatgacttgcagacgaaaaaagaaaaaagagtgcttcatcacgtcatctgggctgattcccgcccgggcatgacgattgccgtcagaccaacggatcaatcggacggagacggcgagttctttttccaaaagccggcatccgtgacacaccgctttcctctccaaaaaaagtatgagagcttcgcgccgatggaatatgattacgatcagacacacaagcggttttacatatttaagcctgaaggccgctcttacaatctgatcagctttgacttaggagacgaacgggagcggacggtgctcaaaaacacggaaatggagccgattcagatctctccgaacggggaatacgctttatacggctttacgtatgaccgtctgatttcactgaaaacgggcatgacagaaccaatcataacaaatgaaaaaggagtttgaaccaaatggcaattgcagatgtcacaatcattccgatcggaacaaaaacaccgagcgtcagtgagtatgtagcggatgtgcaaaaaattttggagggttacaaagctgccggcaaaatcaaatttcagctcacgccgatgaacacgttgattgaaggtgagctgagcgacttattcgcagtcattcaggatattcacgaagccccgttccaaaaagggctgcacagagtggcgacaaatatccgcattgatgacagacgtgataaagaaacgacgctggagagcaaaatcaaaagtgtcagcaaacatttgcagcaataaaaaataagcctgtatccattggatacaggcttttaatgtgcagtcggatagccgctggttacaacggtcattacggtaaaccagccaaacacgcccagcgtggcggcggctaacaaaaatcccaggatatttctctgtctgacagcccgcaggactcctaatacagctaataatgcgacaaggccgaagattacaacaagtaacatcatgctcctcctttgtcattggaacctgaaaatctttccatttcattttaaccgttttcattttgtttgtcgatagcgttttcccggccgcattcattgaatcttccgcagaaaaccttcataataagggcatatacataaagaggtgatgaaagtgaaatggagacgaatgccggccgggccgattcaggcaaacgcgtattttcttgtcagtgaggatcagtcctgtcttatttttgatccgggcggggaagcggacaaaatcaacaattacataaaagaaaacaatctgaagccgctggccatcttactgacgcacgctcattttgaccatatcggcgcacttgacgaagtaagagacagatgggatgttcccgtataccttcacaaaaatgaagaaaagtggctggaggactcttccttaaacggatcaggcatattgcggggcatcgccgtaacggcacggcccgccgaacggctcatcgaaggcgacggcattttggacatcgggcctttccatttggagacattgtttacgccgggacattcaccgggaagcgtttcttattatgtgaaggacgcggatctggtgatttcaggtgatgtgctctttcagggaggcatcggccgaactgatttacacggcggaagtcaggacgtattgcttgattccattcatcaaaaactgctcacgcttcccggacatacacttgtgttaagcgggcacgggccggaaacggacatccagacagagcaggagcgaaacccgtttatcaatggtttttcactgtaaatgaaaaaagacagaccataatcggtctgtctttttctgttcagtgggttccgccgcccggtgtcataataaaaatagagtagtatgtaaatccggcgaaaaatacggttaagtaagctccgaaaatataaatatacatccgctcagtcagattcaaataagaaagaaatacgaaaaagatcgtctgtccaaaaaacaaaagagaagcgtctttcatgccccctagaaaaaacatgactgcaaatatccccgtccaaaatcctaacacccggaacatgcgattcattccttatcccctcccgagagtctatctgaagtttattataatagatcggcactcaaaatgtaaacattttcatgattatatttattgtggaatttatgtctttccctgtgttttatatcttatgccgttctctaaaaaagatccgaaaaatctttttgaaatacgtttagggaaaaaaagttcagggtacttatgttaacaaagagacggattatccgagggaggaatttttaaaaatgaaagaacttattttttattcatacccgagctgcacatcatgccgaaaaacgaaacattggttaaaagcccacaatgttgactttcaagagcgacatctattcagggagacaccgacaattgatgaattgaaacagatcttatcattaacgaccgaaggaattgatgaaatattggcgacgagaagccaaacatttaaaaacctcaacctcaacattgaagaaatgactgtaaatgaagtgctgaagcttttgactgagaagccgaaactgctgcggcgtccgattctgatcgatcgcaataagctcgttatcggatacaatccgggagaactgatgaagctgacgaagaaaaaaacggtacatcaatctgtatcataagagaaaaacgaagatccgctgatcaaatttatcagctaatcttcgttttttgcggttgcgggactgggctagctggattcgaaccaacgatcacggagtcaaagtccattgccttaccgcttggctatagcccatcggatgtaattacagtatgtgcgtccggcgccgatttatacatacaaagtaatttgaatggaggagacccgtgaaacatttgaatgaaacattatctcgaaccttaattgaagaatcaggtgaaatcacacgccagtggctgctcataccaaaatcggggcggccttcagatgatcagaaagcggaaatgcagcaccgtctgttaattgaaatcgttgccggcattttatcggaaaaagaaggcggagaagaggagctgacaaagtgggcgcttcagttcgcaagggaccgggccgtccatgaagtaccggtctatgaaagcgtcacgagctttaaagaattccggagattggtctggaaccgtatacagacatgctgcgaaacgatgtctgagaagcccggggcgaatgcggtattccattggggagagaagctgaacaaagcaattgaccatatgattgaagtatttacagaggaatattataaagtgacggttacacaattaaacgcccaaaaggaaatgattaacgaactgagcgcgccgattatgccgattgccgccggtattggaattttgccgcttgtcggcgaaattgatacctaccgggcaaaaatgattttggaatcggtgcttgaccaatgttcttcactccggctttcttatttatttttagatatatcaggtgtgccgattgtggatacgatggtcgcttatcagattttcaaagtgattgacagcacaaaacttctcggcatagaaacgacaatctcaggcatcaggccggaaatcgcgcagaccgtcgtgaagctcggcatcgatttttctcaggtgaaaacggagcagagtctggcgaaggcgctggcaaaaaacggatttatcgtaaaagaatcattaagatgataaaaagctgaatggccgggagggatttctccctcagctattcagctttgtcagcttcaatcgtcatgatatgatggctgtcgatttcttttaccgtaaatgtgtagccttcaaaatcaatggtgctcccgggcttcgcgtcaatatgctgagtaagaaaccagcccccagtgtatcgacttgatcagccgtaatctctgttccgagtaaatcattgacgtcactgatcagcaatttggcgttcaggagatagcggttcttcccaagcttttgaacggaaggtgtttcgtccgtatcaaattcgtcgcggatttcgccgacgatctcttcaatgatatcttccgccgttactaaccccgcggttccgccgtattcatcaatgagaatggccatatgggcgtgttcccgctgcattttaacgaacaattgataaatcggaatcgtctcaatcacatggatcgccggctgaatgtaagggctgagttcgtgttttgtaaacgccgctccttctgacaggaatctgaataaaacttcttttatattgatgatgccgactacatgatctttatctccttttacgacgggataccgggtatatttatttgttttgataatgtcccggagcatatgtcccgatccgctgtctaacggcaggctcaccatttcattccggggcaccataatttctttggcagtgcgcttatcaaatgtaaaaatgttatttacgtaatgcagctcactttttttgatcatgccgcttcgatagctttcggcaaggagcacccgcaattcctcttccgtataagccatttcatgttcggaagcaggcttcaagccgaacatggctgtaatcaggcgggcggaatgattgagcagccagatgaacggaaacattaacttataaaacaaaatcatcggtctggcagacaaaagtgtaatccgctcggctttttggatagcaaaacttttcggggcgagttcgccgatgacgacattcacatatgtaaccagcagaaaggcgatgatcaatgacagtacttgggcaaccgcttcgtgaactccggtctttaaaaataacggctgaagcattgctttgactgtcggttcacccagccagccgatccccaaagcggtgacggtgatgcccaattggcacgccgataaatattcatcgaggtgtgtaatgacatgcttggctgcttttgctccttttacatcttcctcaatgagctgattaatacgggagcgccttgctttaacgattgaaaactctatggcgacaaaacacgccgttaataatataaatagtacgatggcggatagtttgatgatatacaatgtaacgccttccgcgaaggaaggcttgcacctcccttttttcggaataataccactgtagaaagctgctcaaacatcgaacctggtttagcccgcctcatttacggtaataaaacaagaaagcgatactggaggatgacaagagatgaaggtacattcgggtgcggactggctgtggtaccagctcggtccgcatgaaaaaacggaagcgaaaaaaatgatccatcacaatcactggccgcaatgcgaaaagtggtttgaacatgaaaatcatataaactttctgcgctcagatacaaatgatcagaataatgaagcggttttcggatctttaatctatcatcaaggattagatgatgaaaaaaaccataccgtatttcacttttatattacgagagacttcttttttacgattaattttgatttttcgctgctgcgcggtgtaaaagaaaagcatgccacacagcagattcaaacctgtgaaaatccgattgaaggcttttttgttctgctgggagagctgatgaattcctatctgatcggactggatgaatttgaagtcaagcagcggacgctgaaatggcagattcatgatgacaacagcaaaggaatcttggaaaatgtgcataaactgcgccatgagctgttcatttggaaaggccttacactgggggctaaaaaagtggaaatggctttaaaagaagcgtttcttccgaaaaatgacaggcagaaagattacctcagagctcatcataagatggaaagagggattacatatatcaatgagtttgatcaggaactgagcaatctgctgcacgccgaggaagtcattacctcccaaagaggaaatgaaattgtgaaagccttgacgatttttacaactctctttacaccgatgacggcgcttggagctctctgggggatgaactttgataacatgccggagcttcattggaaatatgcgtatatctgttccatcgtgctcattattgtatcaaccctgctgatttatatttatttgcggcagaaaggctggacaggggacattttgagggagcatcaaaaaaaatatttgcggaaagaaaagaaacgctaagaagagcaggcatacgcctgcttttttgatggctgaaaatggccgaatggttccggatttcattcagtaaatcaatgtcagggggcttattttttatttttttgcgttttacacagtgtaaaacgcataatctctcctttgccggcttttgtgtatctgatttacaatacgtgcggaaggagggaagtcttgtgaaaaatattgaaacatacagcaggaacatcataaacgaggcctatacggcaagggcttcagatatacacattgtgccgagagaaaaggatgctttcattcattttcgcatcggccatgctcttgtgaaaaaaagagtcttaaaaaaagaggaatgcgtaaggcttatttctcatttcaagtttttatcggccatggatataggagaaagacgtaagccgcaaaacggttcattgtctctgccgcttccgacggaaaccgttcatttgagaatgtcaaccttgccgacaatgaatgatgaaagtcttgtcatcaggcttttgcctaagcggcagattccccctctggataaactgtccttatttcggggggcgggcgccgcactattgtcctttctgaagcattcacacggcctgcttctgtttaccggcccgaccggctctggaaaaacgaccactctttactcgcttgtcaactatgcaaaacggcatttcaaccggcggattgtcacgcttgaagaccccgtagaaacaagagatgaggatgtgttgcaagttcaggtgaatgaaaaagccggagtcacatattccgccggtttaaaagcgattttaagacatgatcccgatatgatcatcttaggggaaatcagagatgccgaaacggctgaaatcgcagtccgcgcggccatgacgggacacctcgttctttcaagcctgcatacaagagatgctaagggcgccatatacaggctgctggagtttggggtgaacatgacagaaattgaacaaaccgtcattgccattgccgctcagcgtctggttgatttaacatgtccgttctgcaaagaggaaaactgttccgtgtactgccggatgtacaggcagacccgccgtgcgggcatttatgaactgctctacgggaaaaacctcacccaatgctttcaggaagcaaagggagagcacgccaattttcaatatcagacgctccgcaggctgatcagaaaaggaatcgcgctcggctatgtcacaaccgacaattacgatcggtgggtgtatcatgaagcggattaaacgaacctggccgttgaaggatcaagcggcttttttgaaaaggctcggtgaaatgacggaaaaaggatacagtctgattgaagggctcagactgctgaaactccagctgcataaacgtcagcttgcagagctgacggacggaatccgcaggctgagggaaggtgatgcgttttacgaagtgcttgaggcactgtcttttcataaagaagccgtctctatctgctatttcgcggagaaacacggagaattgccgggggcgatgaaacaaagcggcgatttgttacagagaaagctcatgcagacgaatcaaatcaaaaaaatgctccggtatccgatgtttttaatttcttccgtctgtgtcatgttttatatcctgcaaagtttaattattccgcagttttctgggatttatcaatcaatgaatatgaatacatccggtgcgactgctttcatctttgcattttttcggcattttcatgaagcctgcgcactggcgctgtccgccgctttctgcttgtttttgtacgtttggttcttatgtaagaaaaaatccccgcaagataaaatgctcattgttgtgaaaatacccctcttgggaaaagcggccgttctttttaacagctactttttctctttacagctcagcagtcttctgaaatccggcctttctatctatgacagcttaacagcttttaaagaacaatcttttctgcctttttatcgtgaagaagcagagatgctcattacacgtctgaaagccggagaaaccatagaatccgctctttccgggcatccgtgttatgaaaaagatcttgcggctgcagtcagccacggacaggcaaacggcctgcttcaccgcgaactttatacgtacagccagtttatgatggagcgtcttgaacaaaacgcggcgaagtataccggcattctccagcctgtcatttacggtgttgtggccggtatgattttaattgtctacatgtcaatgctgatgccgatgtaccagatgatgaaccaaatgtaagggagtgcttcgtctgaaaaatcaagatgggtttactttaattgaaatgctgatcgttttatttatcgtttccattctgcttttaatcaccattcctaacgttacaaaacataatcaaagcattcagcataaaggctgtgaaggactgcagaatatggtgaaagcccaagtgacggcgtacgaaatcgaccatgaaggtaaaatgccggatatgaacgatttacaatcagaggggtatatcaaaaagaatacagcctgcccgaatggtaaacagatcttaattagtggcggagaagttacagttgaacaataacaggcggacagaaaacgggtttacccttcttgaaagcctgattgtgttaagcctggcgtccgtcctgctgacggttttgttcacgacggttccgccggtctgcacccaccttgccgtgcggcaaaaaacagaacagcttcaaaaagatattcagcttgcgcaggaaacggctatcgcagaacataaaagaacaaaaatcacttttcttccaagagagcataaatacaaactgcagtcagccggaaggattgtcgagcgttcttttgattcgcttcacattacacttgtgactttaccggagagccttgaatttaacgaaaaaggccatccgaattcgggaggaaagattcgattgaagagcgccgggttcacctatgagatcacagtttacttagggagcggaaatgtccatgctaaacggaaataaagggttctctactattgaaacactatcagcaatggccatttggctgttccttatgacgtctatcattccggtctggacaggcatgctgacagatggtctgaaaatagaagatcgccaggaagcgtatcagcttcttcagaaacatatcagcacttatatgatgaccggaaaaaagccgccgtctcccggtgtgaagtggaagggggatggtgagtattacaaagtgtgtgcggctgaccgcggcgaaaaagaaatgtgcctcagcattctcaaaacagactggctttacgcttcttaatgttttgttctccttggcagtctgtcttttcctatcaggcaccctgggcccgattttacatctgtttttatcaaaccggaccgataacggcggattagacagccgggagcatcaaattgccgttcagcagatcatgaacgaatgtaaacaggctgagactgtgaagccggcggacggcggattggcgttagcatgccggaaaacagggggcgaagaagtgcgttttgaaatttatcataagatgataaggaaaagagtaaacggaaaaggccacgtgccgatcctgcaaaacgcggcatcattaacggctgatgtgaaaaacggcctgctcttattagagatctcaagcgttacaggtaaaaagaatcaggcggtcattccggtttacagctctttaaaaggtgattaaatgtacaaatctgacggttttatctatcccgcggttctgtttgtttctgccgcagttttacttgtcatcagctatacttcatctgatttcatcacccgaaaaacatttgcgaaagaggccggggagtactggatcggagagaatctgctccaaaacggcgcgctgctgtcaagccgccatatgacacagggacaaaaggtccaaactggtacacagcgttttccgtacggaactgtttccttccgcatcaccgggagtaatcgccgggaaacggttcaggttacaattcaggccgaaacagtgtcaggcacgagacgggaggctcaccttttgttcgatcagaagaagaaacagctgattcaatggacggaagtataaaaaagaggcggcgggacaacacttcatagtaaagacagcactatgaggtgagagccgtgaaaacaaatgattatgtaaaatatatgactgagcaattcgttaaatatttcgatacgccgaaacaggaacggagagagcgaaaagaagtgcggaaagaaaagaaagtgccggcttctcagcactggttcggaatattgccgtacagttttaagctgtggatgcagcggaaaaaataaagcgaatcacacataaggtcctcctgtatcaggagggccttattggtattcctcaatgacggcaattttatttaccttttggctgtagggattaaaagaaatcgtaacaaacacaccaaattcttttgcgccatcccgcaatgtcaagtggtattgtttgactgcttcgtccgttcttttccggtcccacaccttttgaataaataacgtttgggcgagcggatatctttttttagcttctttttctgctaacttttcccattttgatttatggtgaacagcataataaggcaccgtttccgcctgagctgttcctgaaaccccgaaaacaagaagagaaaggcaaatcagactttgtgtgatcatcattcttcgtcctttcgctgtatatactttccattttgtgctaggcacctcgttattttctcacgttttattagaaaaaattccaaaaaggtgtgtaatttgaagcaaaacgatgtttttgaaagataccattctcaaaaacgaacaaattgaccgattttgacatttttcaagacgataatccttgattatactttgttcatgaagttctttaaagagaacggttgtcatatttattaacagttttacagggggtaaggcatgttccgattgttgcgaatggaaaaaaagggcaaggtgagatggcggatgatgctatttttacggctttcgttcattttttgcctgtccgtgacgatatgtgctcagttcacaggtgatacaagttcctccttcaatgatgtgaaaagcttcagtctcccggttcaaacgtgcggagattttcaatatacggatgacgattgccgttatgacgaacgctgggatcagagtgatttacatataacaaatcaaactgatacgtcaggcaccgtgtgtgcgccgcttcaactctatgccgagctggagaataagggaaaagagcggactgtttctgactggaaatgggagctccataaaatcacttctcagcagcagcctttacgaaacggcaatgttgtggataaagggcttattactgataaaaaaagcaaaacgatttataaaattgagtcaaagcggtctttgcagccgggcatatacgcattcaagatttacaagcctgaagggtatccggcggacgaagaacaatttgagtggtcaaaaccgatgaaactcgtcaaatgccgggaacaggcaaccgtttccgatctgaagaaaacggagaaagagccggctgagccggtaaaagaaagcggggaagaacatgaaaaaaacgctgaaactgatcagtaatattttgtatgccgtcatcttcagcctgattattgtgctgacgttaacggtgatttcgacccgggcttccgggggtgagccggccatcttcggctatacgctgaaatccgtgctgtcgggttcaatggacccggaatttaagacgggttcgctcatagcggtaaagaaaatttctgacgtaaatgacttaaaaaaaggggatgtgatcacctttacgcaagatgacggaacagccgtcacacacagaataatcgggatcacaaaaaaggacgggaacctgctgtttgagacaaaaggggaccataatgccgccccggatgccgcccccgttcaagctgaaaaagtggcggcccagtatacgggatatcagcttccgtatgcgggatatgtcatacatttggcaagccagccgatcggaacggcgattctgttaatcgttcccggcgtcatgcttttgatttactcaataacagtcatcgtcagcgccctccgcgatattgagcggaaaacgaaagcgctggaagaacatgcgaaaaagagaaccatctccacatgaatacggttgcaacctggcgacaggatttgataacaaaaaataaaaagtaaggggagtacaaacatgggtatgaaaaagaaattaagcttgggcgttgcctctgccgcactcggtttagcattagtaggaggaggcacatgggccgcatttaatgatgtgaagtcgacggacgctacatttgcgtcaggaacacttgatttatcggctaaagaacaatcagccaatgtcaatttgtcaaacttaaaaccaggtgataaattgacgaaagattttgaattcagaaacaacggttcacttgccattaaagaagtgctgatggctttgaattttactgactttaaaggagcaaagaaaggcaatgaatctgcggaggatttcctcagccagtttgaaattacggttctgacagtcggtaaagaagggggcaacggctatcctaaaaatatcattttaaaggcggccagcctgaaagacttatacttaatgtcaacaaagcaggataaagcagctgccgaagcgatcagcaagcacattgatccgaaattcctgagcgagagcggaaaagtcaatgtggcaaccattaacggcaaaacagctcctgagtacgacggagttccgaaaacgcctgctgattatgaccaggtgagaatggaaatccaatttaaaaatgacaccgcaaaaactgcggacggattaagtgtgcaaaacaagttccaaggcaatgcgatttctcttcaattctcttttgaagccacgcaatggaacggcttgaccattaagaaagatcatacggataaagacggttacgtcaaagaaaatgaaaaggctcacagtgaggataaaaactaatccgaaagtcggacagttaaaagaggagttgtgcacatatggcggcactactcctctttttgcgcttttctccatttttgataatctaaaaattcacgaaattgtttttttgataccccggatgtcatcgcatcgcgaactaatttctcccattcactatctaattgaccatcgtattcggtttcatgtttttcatcaagtaaagtatgaaccgagacgtccagaacagcggagactttttcgagaaattgaatggaggggttcgtctgtaaatttcgttctattgagcttaaataagacttcgctaccccagctttttcagctagttctgatagtgagtagcctttttcttttcggtattgtttaatacgctggccaatcaatgtcatcaccttccttgtgatattatagcacattcagaaaggatttacggtatgacttctggctgcctggatatgttgagaagactttttatgcgaaagcaggtatttgcgtatttcttctaggctgatatttgctttttgggcttctaatatcagctcaacccattccttatctaattgcgaaaattccatttttgcatttttcatgcattttctcctcctaaaatacttgtttatgtatttcagccaatccgcccatgaccttatctttacatgtctggaagtgattcatcgcatgcgaaacgccagaaattttttctatatacttttattataatatagaatttccagaaaaaacgggaaaggtgtcgaatggataacgcttatccagaaaaattactttgcaggaaaaataaaccgccgttttcaatctgaatgtgaattttcggctgatataaggctttcagcgcttgtttttccaaatggtattcctcaggtttttcttctgtctgctcataaaactgatcgagcagcctgaggtcctttttccatctggcgatcgcgctgtcagcccagtctgacggctctttggcggcagcgtcttttaagtaatgctccatccttttaatcccgctttccggcttaatcatcggcgatatggtaaagcaatagtctgatatttgcgaggtcagcggaagcggtgcaagcttctgctgaaacccttctataattgttccagaaacaagatgcaggcctaaagacaaaagtctgtcttttttcatgtcggattggtatgaaatcactacatttaatccaagccagggctgaagcggcactctggctccggctgatacaattttctcatatattcttgtaaatctcccattttgtttaactgcttgaaagatttgaaagaggcgcggggctccaaagtaaataaactcgccgtccatatcctccggagccgtttctttatcagtgatgaacgtaatcttcatcgggttcggttcgccgcccgttttttcacgccaatgccaataaaacgggcggttcataatttgtttgtccatctcgaccgtcaactgaaccgtcataaaacccggcccgtgttctgtaatcgggcagtggttcgcttcaaaaaagcgcagtaaaaattggtgaacctcctgctgtctcatgtcgcgcttcctcctttttaagagcctttttttctggcgggcttttccgtaccgtacgacagaaaagaggtgagattgtccattttgattctcatttcctcctctgtcagcgaatggcataaaatatcatgcaaatggtcttcaaaattgctcactttgatttttgttaaaatgtcatctaattctccgacgacattttcaaataaatgaattttgtcatacagaagttttaagatatgctcttccaccgtatgttttgtcgccatattgtagatatggacatctctttcctgaccgagtctgtgaatccttccgattctttgttcaagccgcatcgggttccacgggaggtcataattgataatatggttgcagaattgcaggttgatcccttcgcctccggcttctgtagcgatcagcacctgcactttgccgcggaaaagatccttcatccagtctttttttccgcgtttaaatccgcctctgaacggaacggagcttatgccgttctgctgaaggaaccattgcaggtaaatctgtgtcgccctgtattcagtaaaaataatgactttatcattaatcttttggatcaagtcaacaacttgaatcgcttttgagttttgcgtgacttgattgatgcggtccattaaattagcgatcgtctgttcatcgaatgcgggcgcttgtttgtctttttggtcaagcatttttttgagcgtcatatacacggcttccctgcttgaacagcactctctttgcagcgtcataatggaaaatgcgcttgcgggcttttccgtgccgtttttcagtgcggcaatgtcatcgtaaagcgcctgttccgtcggtgaaaaggtgatcggcactgtttccacgtggcgcttcgtccatgtaaggccggtgtcgctccgcgtgttgcggatcatcaccttattgacgagttctttcaaatgctcatgagcgtcaatcccgtccttctgattgaaggtttcttgaaatccgctttcatttcctaaatggccgggctttaacagtgacactaaattgaagatttcttcgatccggttttgaatcggcgtcgccgtcagaagcaggcagtatttcttcacaagacttctcgcaaattcataatttttcgttttgctgtttttgagcttgtgcgcctcgtcaataatgacgagatcatacggaatagaaaggacaatgtctttgtgaggggagcgtttggccgtatcaatagaagaaacgacgatatcgcactgttcccacacatagcttttcttctgttcaacagcgggtattaaaaacttctcctgaagctctttcacccactgggaaacgagtgatgccggcacaagaatcaggatttttttggccagcccgcgaatcatatattcttttaaaatcaggcccgcttccaccgtttttccgagccccacttcatcagccaaaatcgccttgccgttcattttttcaacgactttctgcgcgacctcaagctgatggggaagcggagtgaaatcgggcaggtataaaggagctctcaacccttcaaattcaggaatggcaagggtctgctggacttcagccgacagtttgtacagctcccaatttgaccagggaccgtccgttttcagccgctcagaaaactctcccggccagtttgcatcaaatatgatctctgctgtcatatgtaacaaaaccgcctttcttttaaaaaactgatttatcataatttttgttgccggacgtaaatgagggtggtaggatataagtaatgatttcactaaaagatattgctttagtatgtccataaaattggtaaatatgagcgaatgacagcaaggggagagactcggacgaaagatgggcgtccgggcgccgaaggagcaaactgcggagtgaatctctcaggcaaaagaactcttgctcgacgcaactctggagagtgtctgcacttagaagaagcaggccaccaaaggggacgtctttatgatatgttcataaagtaaactttcaggtgccgggacagagaaaccttcattttcatgaggtgtttctctgtccttttttatatgtttttacaagcgccaatgactgaagggggaagatgatgctgaaacgaacaccgctttatgatgtgtataaagaatacggcggaaaaacgattgattttggaggatgggagctgccggttcaattttcttctattaaagaggagcatgaagccgtccgcacaaaagcgggcctgtttgatgtgtctcatatgggggaagttgaagtatccggtaaagacgccctgtcttttctgcaaaaaatgatgacaaatgacgttgccgatttaaagccgggaaacgcgctttataccgccatgtgctatcctgacggcggtacggtcgatgatttgctgatctatcagaaaagcgagagctgctatctgctcgtgataaacgcgtctaatattgaaaaagacatcgcctggctgacagaacatgcggaaggagatgtcacgctgacgaatcagtctgacgggatttcactgcttgccgttcaggggccgaatgctcagtcggttcttgcgaagctgactgaatgtgatctgtcctccttaaagccgtttgcatttattgacgaggcggacgttgccggacgccaagtcctgctttcaagaacaggctataccggtgaagacgggtttgagttatattgccgcaatgaagatgcggttcatctatttaaggagatacttgcagcgggagagcatgaaggcctcgttccgtgcggcctcggcgcccgtgatacgctgagatttgaagcgaagcttgctttatacggtcaggaattgacgaaagatattacaccgattgaagccggaatcggatttgccgtgaaacacaagaaagattccgattttttcgggaaatctgtattgcgtgaacagaaagaaaaaggagccccgcgaaagctggtcggacttgagatgattgaaaaagggattccgagacacgggtacgccgtgaaaaaagacggtgttccgatcggggaagtcacgacaggcacgcaatctccgactttaaagaaaaatatcggccttgccttaatcaaaacggaattcagtgaagtcggaacggaagtagaagtggaaatccgtaaaaaaacggtaaaagcgaagatagtccgcacaccgttttataaacgtccaaaacagagctgaaaaaggagagtcatatgaagcatcgatatttgcccgcgacagaacaggataaaaaagaaatgctgaaagccatcggcgcagaaacaattgatgaactgtttgccgatattccggaagatgtgaggtttcaaaaagactaccaaattaaaaaagcaaaatctgaaacggagctgacgagagagctgacaaagcttgcggcgaaaaataaggacgctgttacatatgcgtcttttctgggcgcaggagtgtacgatcactaccagccggtcatcgtcgatcatgtgatatcccgatcagagttttacacggcatatacgccttatcagcctgaaatttcacaaggggagctgcaggcgatttttgaatttcaaacgatgatctgtgaattaacgggaatggatatcgcaaactcctctatgtacgacgggggaacggcgcttgcggaagcggcgatgcttgcgtcgggacatacgaaaaagaaaaaaatcattatttccgcagccgttcatccggaatcacgggatgttttgaaaacatacgcaaagggccaatatattgaggttgtagaggtgcccgcgaaaaacggcgtcacagatcttgaagcattggaacatgccgtttgtgatgagacggccgccgtgatcgttcagtatccgaacttcttcggacaaatcgagccgttaaaggacattgagccgctcgcacataaaggaaacagccagctgattgtttcttcaaacccgctcgcgctcggtattttgacaccgcccggggcatacggagctgatattgtcgtcggagacgcgcagcctttcggcatacctgcggcgttcggcggcccgcactgcggctattttgcagtaacgaaaaaactgatgagaaaggtgccgggccggcttgtcggccaaacagaggatgaaaacgggcgaagaggttttgttctcacccttcaggcgcgcgagcagcatatcagaagagacaaagccacgtctaacatttgttcaaatcaggcgctgaatgctttagcggcttcagtcgcgatgacggcgctcggaaaaaacggcgtcaaagacatggcccgccaaaatatattgaaagctgattacgcgagacgccaagcggaaaaagccggcttgcacgtagcatttgacggcccgatatttaatgaatttgccgtcaggctgaatcttcccgtcaaggaagcaaaccggcggctcctgcaagacggcatcatcggcggatatgacttaggtcttgcgtatccggaactggatcagcatatgctgattgccgtcacagagctgagaacgaaagaagagatcgattcgcttattgcgggattgggggatcaacatgaataatcaagatcaggcgcttatttttgaaatgtcccgcgaagggcgtgtcggttacagccttccggagcttgatgtgccggaaacagagcttgaaagccttcttcccggtgactatatccgcgatgaagacgcaaagctgccggaagtatcagagcttgatattatgcggcattataccgctctttctaagagaaaccacggagttgattcaggcttttatccgctcggctcctgtacgatgaaatacaatccgaaattaaatgaaaaaattgcccggttcgcaggtttctccgctattcatccgcttcaggacgaggacacggttcagggggcgcttgagcttttatacgatttaagcggacacttggaggagattacgggcatggacgaggtgacgctacagcctgcggcgggcgctcacggcgaatggaccggcctgatgatgatccgcgcctaccacgaagcgcggggagacttcggacggacgaaggtgattgtccctgattcagcccacggtacgaatccggcatccgccacggtcgccggttttgaaacgattaccgttaagtcaaatgagcacgggctggttgacattgaagatttgaaaagagcggtaaacgaagaaacagcggcgctgatgctgacgaatccgaacaccctcgggttatttgaagaaaacattacggaaatggctgaaatcgtccatcaggccggcggaaagctttattatgacggagcgaatttaaatgccgttttaagtaaagcaagaccgggagatatgggatttgacgtcgttcaccttaatctgcataaaacatttaccgggccgcacggcgggggaggaccgggctcagggccagtcggagtgaaaaaagaattcattccgtatctgccgaaacccgttctcacgaaaaaagagggccgtttgacttttgactatgaccggccgcagtcgatcgggcgcgtaaaaccttattacggcaacttcggcattaatgtcagagcctacacgtatatccgttccatggggcctgacggcttaaaagctgtgaccgaaaacgcggttttaaatgcaaattatatgatgagaagactcgcgccttattatgatctcccgtttgaccgtcattgcaagcatgaatttgtgttatcgggaagaaggcagaaaaagctcggcgtaagaacgcttgatattgccaaacggcttttggatttcggctatcatccgccgactgtgtattttcctctcaatgttgaagaaagcatcatgatcgaaccgacggaaacggaatcgaaggaaacgcttgatgcgtttatagatgccatgattcaaattgcgcgggaagcggaggaatcgcctgaaatcgttcaggaggcgccgcatacaacagttgtcaaaagaatggatgaaaccaaggcggctagaaagccggttttaaaatacgaacgtacacctgacgtcagccgctgacacggtataaaaaaagagcttccgtataaaacggacagctcttttttcatgattagttttttgctttaatttttccgccccattttttaaatccgcctttcaggttgtaaatatctttgcagccgtgtttgcggagcgtctgtgccgcgcgtccgctgcggacattgttttggcagtacagataaacgggtttatcaggacggatttcacttttgcgctgtttcagctgtgacagcggaatgttgcgcgcgccgagaatatgaccgccttcaaattcattcggttcacggacgtcaatcagctgcgcttttctgtagcccgcgcggaattcctcttccgtaagtgttttcattaaacgctgctggtaaaagtacgaaacgatcatataaacgataaacgccgcaacaataattaaagcaatcatattagacaatgcaattctactcctttagcttataaaatcaaaaccctgcttcctgaaaacaaggcttaccggacgttttgggacaaatactattatagtaaagcatgaagcgattgtcatccttaatgaaacgaaatatttttcattttcaaggcagtttgttaaactggttttattaaaacgataaagaagggttcagtgtatggaaaaagaaacatggcggtttattgactcagggaatgaaagcccggcatttaacatggcgctggatgaagcgcttttatattggcacagccaaaaaaaaattcctccggtgatccgtttttacggctggaatccggcaactttgtctgtcgggtattttcaaaatattaagaaggaaattaactttgacgcagtacataaacacggcctcgggtttgtcagaagaccgacaggcggacggggtgttctgcatgataaagaattgacatacagcgtaatcgtttcagaggatcacccggaaatgccggccacggtgacagaggcgtaccgggtgatttcagaaggtattctgcagggattcagaaaccttggacttgatgcctgctttgcgattccgcgaacggagaaagaaaaagaaagcttgaaaaatccgcgctcgtccgtctgctttgatgccccttcgtggtatgagctggtcgtcgaaggacggaaagttgccggaagcgcacagacacgccaaaaaggcgtcattcttcagcacggttccatcctgcttgacattgatgaggataagctgtttgatctgtttttatatccgagcgacagagtccgtgagcgcatgcagcggaatttcaaaaacaaagcggtagccatcaacgccttaacgccgaaacgggtaacgatggatgaggccagaatcgcttttaaagccggttttgaggaagggctgaacattcatcttgagccttacacactcacgtctgaagagcttgcatttgtcaatgagctggctgagacgaaatacgcgtctgatgaatggaattataagcgctgataaggcttgacagaccggaagcatccttgttttttcatgaccgttagtgtaaacttgtaatggtttataaagttaaggtgctttttgggagggttacttatgacaacaccaagtatggaagattatattgaacagatttatatgctgatagaagaaaaaggatatgcacgggtttctgatatcgcggaagctttggcagtccaccctcctctgtaacgaaaatggttcaaaaactagataaagacgagtatttgatttatgaaaaatatcgcgggctcgtattgacgtcaaaaggcaaaaagatcggcaaacggctcgtatacagacacgaattgcttgagcagtttttaagaatcattggtgttgatgaagagaagatttacaatgatgttgaaggaatcgaacatcatctgagctggaacagcattgaccgcatcggcgacctcgttcagtattttgaagatgacgaaagccggaaaaaagaattgaaatccgtacagaaaaaaaccgaaaatcccggtgaataaagggcagcccgaaatggggcgccctttttttaatgtcttcattctttggtctatttcgcccagccgtttcttaaaataataatacaccttgagatggaagggagagggcgcgctatgcagattgacggcgtattttcgggcggggggataaaaggggtggcgcttgccggcgcttatgaagcgctggaagaaaagggctttcgctttgaaaggctcgccggaacaagcgccggcgcgattattgccgcatttatcgctgcgggctatacgagcagagaggttcattccatcatagatgaggtggacggaaggcaattgcttgatcagagatactcattcctcccgctgaaaatcctgcagtgggtgtcgatatattggcgcctcggactatacagaggcgatatgctggaaaagtggattgcggataaattaaaagcgaagggcatcatcgcgttcggcgatttgaaaaaaggctcgctccgtctcatcgcttcagatctgacgaacggaacgatgatcgtgcttcctgacgatcttccccgctacggattaaatccggagatgttcccggttgccagagccgtcagaatgagctgcagcattccttatttttttgaaccgataaaactgaagaccgaaaaaggcacctcaacggtcgttgacggcggcgtgttaagcaatttcccgatttggctgtattcaaaagaacgcaaacggccggtcatcggaatttcgctttcgcccaacgaaaaagagcgcccgaaaaaatcaatccgcaacgcttttgagctgttcggggctttgtttgaaacgatgaaagacgctcatgatgccaggcatatcgcgacaaagtacgaacagaatattatttttattccggtggaacatgtgatggcgacggagtttcatctcacaccgcaaaaaaaactagctctcattgagctaggaaaaagcagaacagagcaatttttgaagcaatggagctattaaaaaagcgctctgtttttctttttattctttttgccttctatgacggtaagctgggtctggctttttttcttaagaatcatcggcttcggtctgctgctgctcggcacgctccgcaaatggctgacccggcctctgtgtccggcgcggtgcttcgctttttgctccttcattcggagccgcgattgtctggccgcttttttgaaagcggttccgtcacggccggtgcgtcggttcaggaccgtcctcacgataaaataaataataatgcctgcgataataacggtgattgctcttgaaatcatctgcccggggttggttaccgccgcataaatgaaaccgaatgcgccaagcgctatcaatacagcaaaaaaaggttgtacacgatgattcataactgcccacctccaaaataataacggtaacggttcagattacgttgtgagacggattttcgctctgttctgaaatgtcttccagtctgagaagctcgttaaagctttctatggcaacctcgacctggtcatccgccggttcctttgtcgttaaaagctgcagccacaggccgggataaccgagcactttcaaaacggggatattccgtactctgttcgtcagctggagcacttcaaaggagatgccgagaacgaccggtataagcgcaatcctgtctaaaatccgcacccaaagcggatctgtcggaacgagtaaatagacgaacatgccgacaatgatcgtaaataaaataaagcttgaaccgcaacggtaatgaagccgtgactgtttctgaacattttctattgtaattggcaaattctgttcataacagtttatgaccttatgttcggctccatgatattgaaacactcttttaattaacggcgtcattgataaaaaataaatgtagccgagaagcagaatcagcttaaacagactttcgattccgatctgcgcggcgtctgaggaaaatacgggccttacaagctccgctaagaagaccgggacgagcgtaaaaacgaatttgctgaacaaaaacgacagaacgccgatcaccgccaggctgaaaaacatcgataagccggaacccttcttctcttcctgctccagcttggcgtcatcctgaggatcaagcccgtaacgttcgctggaaaagtttaaatgctttgtgccgttggcgctcgcctcaatgatggcgacaattccccgcaaaaaaggaatcttttttaaagccgaaagcttggcgttcggcactctcggaagcttgaaaaaatcaatgcttccgtcattcctgcggatggcggtaacataattttttctgccgccgaacattaccccttcaacgacagcctgcccgccgtatgcagggggcgttttttgtttggacattgtttatcaacctgcctgttttcttaggatttactaaccatttcctttcactctattgtacaggaaaccgcggtaaacctctagttagacagccggaaaatcaatgctttttctacatgcagtataccccgtttctttagattttactcattgaatgaaaatatggcgcagctttttatgacttttcaatttttgggcagtctatgactggaggtgccatgatgacaagcgaaaaacattcagaacaggaagaaaaaaagaagcaggatgatgatcagcagcctgtttcatttaccggcagaatttgcggtatcggatttgccggcggtgtattttggagtttgatcggctatctcgggtatgtctttcatttttcagagatcagccccaacatgattcttcagccgtttatgatcggagaatggaaaaaacaatggctgggcacgatggtcagcatcgttgtcatcggattcatttcaattgccggggcgtttatttatttcgtctgcctgaagcgttttaaaaccatgtggccggggatggtgtacggcgtcattttatggtgtgcggtttttttcttattcaatccgattttcgaagatgtgaaatccgtcactgaattgaaatcagatacaatcgtgacgacgctttgcctttacattctgtacggtttgtttgtcggctactcaatttccttcaactacaatgaacttacgtcagacaagcttgcaagggcgctcggcaacaagtgaataagtgtataatccctgtccggtatggtaaaatgttcacgagaagtgaacattttttatgctgaaaaccgggcagggatgctcccgcgttgtcaggcggcagtcaagaatcggcgaggaggagaaagggaatgaaacttgagaaattgcgaaatcttttcggtcagctggatatagacggaatgttggtgacaagctccgccaatctgcagtacatgacgggatttacgggttcgtcaggccttgcggtcatatcgaaagaacgtgcggcatttatcacggatttccgttacaccgagcaggcgaagacgcaagtgaagggttttgacattatcgagcacggcggaagcttaatccaaacggctgcggatacgattcttgagtacggcattaaaaaactcggcttcgagcaaaacagcatgacgtacggaacatatgcatcctaccaagcggtgctgcaggaagcggagatggttcccgtcgcggattccgttgaaaagttgcgcttgattaagtcaagtgaagagattaagatattagaggaagctgcgaagattgcggatgatgcgtttgaacatattctgacgtttatcaaaccgggcatctcagagatttcagttgcaaacgagcttgaattttatatgagacgtcaaggagcagacggctcttcctttgatatgatcgtcgcctcgggagtcagatccagccttccccacggagtggcaagcggcaaattgattgaaaagggagacttggtcacgctcgatttcggcgcttattataaaggctattgttctgatatcacacgcaccgtcgcggtcggagagccaagtgataaactgaaagagatttatcaggtcgtatacgatgcccaagcgcttggtgtcctgcatattaaacccggcatgacgggaaaagaagcggatgccctgacgagggatcatatcaccgcaaaaggctacggacagtatttcggccattcgacaggacacgggttcggaatggaagtccatgaatcaccggggctgtctttcaggtcatcggccgttcttgagccgggcatggcggtaacggttgagccgggcatatacataccggaagtcgggggcgcaagaatcgaagatgatatcatcatcactgaggacggcaaccggacaattacgcattcccctaaagaattaattattttgtgatcggagtataggaggacatcaaacatgatttcagttaacgattttcgtacaggactaacgattgaagtagacggcggcatttggcgcgtcgttgactttcagcacgtaaaaccgggaaaaggagcggcatttgtccgttctaaattgcgtaacctgcgcacgggcgctattcaggagaaaacattccgtgcaggtgaaaaagtcgcgaaagctcaaatcgaaacaaaaacgatgcagtatctttatgccaacggcgatcagcacgtgttcatggatacaagctcatatgaacagcttgaattgaacgaaaaccaaatcgaagaagaattgaaataccttctggaaaatatgtctgtgcatatcatgatgtatcagtctgaaacgctcggtattgaactgccgaacacagttgaactgaaagttgttgaaacagagccgggaattaaaggcgacacggcgtcaggcggcacgaaacctgccaaaacggaaacaggccttgtcgtaaacgtaccgttcttcgtgaacgaaggcgatacgctggttgtaaatacatcagacggttcttacgtgtcaagagcgtagttaaagaaattcggagtctgctccttttacggggcaggcttttttttgcgttctgcctcagaatctttcttctatatgaaaatagtgagactacttccgtgagctagagcatatagtgtaacaaaatgcttgaagttgggggattgcaatgaaatttttgttcggttcaatcaattctactgttttaacgatggccggtttacgagttttgtcctcgctcattgaattatctgccgctattatcatgcttttgacaaacgacatcagaaaagcggttgtggtgaatagtattttggcaatcgtcggccctctgatctttatcatcacaatgacgatcggcatttatcagattgccggacagctctcatatgcaaaattaatattgatttttgcgggtgtggtgctgattttggccggtgtgcataaatagagggccggggtgtcataaagtctgtcccggatcatacattttaaagaagccaatcggtaaaaaggaggggactctattgaatgaaattacagaggttctccctgaattattgagagatgccatctccgccgtgcccgaagaagcgaggcgggatacagaagaaatcagaatccgggtcgacaggccggttgaactgatccaaaaaggacaacctttgtatttgtcatatgtgtgtacggccggcgacgcacagctgatcctcagccggctcagcaactatagtatgtacacgctggaagaagagctgaaaaaaggatacatcacaatcagaggaggccaccgtgtggggctggccggaagagtcatcgtcgaaaacggagccgtcaaaggactccgggatattacttcttttaatatccgaatcgcccgggagaagctggggatcgcagaaccgctcattcctttcttatggaaagaaaactggctgaacacgctgatcatcggtcctccgcaaacggggaaaacgaccttgcttcgtgatttggcccggctttccagcaccggatcaaaacgcattccggcaaaaaagacaggtatcgtagatgaacggtcggaaattgccggctgcctgcggggcattccccagcacagtttcggccgcagagtcgatgtccttgatgcctgtccgaaggcggaagggctgatgatgatgatccgttctatgagtcctgatgtcataattgtggatgaaatcgggagaatggaagactcacaagcgctgctggaggcgctccatgcgggcgtatccgttatcgtctctgcgcacggatggaatatgaaagacttggtcaagaggccgtcgctgaaaatgctttgggaggaaaacgtgtttgaccggtatgttgaactgtcaagacgccgcggtccgggaacgatcagcaggatgtacggaaaggacgggaaacctgttccgcatgctgaaagcgtgatgacatgctgaagcttttgggtgccgtgttcattctgacagcgacgacatggacgggatttgagatcgccaaaatgtatattgaaaggccgagacagatccgtcagctgcgcgcggcgctgcaatcgcttgaagcggaaatcatgttcgggcatacgccgctgcacatagcttcgggacaaatcgccgcacagctttccaagcctgtatcgtcattgtttcaagctttcagcaggaggcttgagcagggaagcgattccgccaaaacggcctgggaacagagcttgaaacataactggccctccatggcgatgaaaaaaagcgaatacgatgtgctgaagcaattcggagagacgctcgggctccatgaccgtgtttctcagcagaaacatatcaagcttgcgcttacacatttggaagcggcggaagcggatgccggacgggcgcaggcgaaaaatgaaaaaatggtgaaaagcttaggatttttagccggactgttactcattcttctattgatgtaaacatgaggggagcaaacataaaatgggagtcgacgtaaatgtcatttttcaaatcgccggagtcggtatcgtggttgcgtttctgcacaccatacttgaccaaatgggaaaaaaagaatacgcccaatgggtgacgctgcttggctttatctatattttatttatggtggcgacgattgtcgatgacctgttcaaaaagatcaaagctgtgtttctattccaaggatagggggcttacagattgagattgttcaaattgtaggtttaggcctgatcgccacatttctctccctgatcgtaaaagaacagaaaccgactttcgcgtttatgattgtcgtcttcagcggctgcgtgatctttctctatctcatcgatcagatttacgacattatcagaatgatagaaaaaatagccgtcaatgcaaatgtcaatatggtctatgtggaaaccattttaaaaattatcggcatcgcctacatcgctgaattcggtgcgcagctgacaaaggatgcgggccagggagcgattgcttcgaaaatagagctggccggaaaaattttgatactggtaatggccgtgccgatactcaccgtcattattgaaacgattctcggacttattccttcttgatcatcaataaaatggaaaggggggcacaaaaaatgaagcgctttcggtgggcgggggcttttttgttcatcctcttattttttcagactgaatgtgtacaagctgccggaacagacggtgcgtcgcaggaaaccgcagttcaccaagaatccgctgatgaagtggcgaaaaagcaggccgaagcgctgaaaacagaaggcatcggaaagttttgggacgacatcatgacagaatacggcggtcttctgcctgaaagccaaaagggaagcatcatcgactttattaacggtgaaaaaacgttctcgccggaggcatggctgaaggctttattttcatacttgtttcatgaagtgctcgcaaacggaaagcttctgggaactttgattcttctcaccattttttgtgtcattctgcagcttttgcaaaatgcgtttcagcagagcactgtcagcaaagtggcttatgcaatcgtctacatggtgctgattattctcgctttaaacagctttcatgttgccgtcaattatgccagtgaagcgatccagacgatgacaagtttcattctcgcgctcatcccgcttttactcgcgcttttggcgtcttccgggggagccgtctccgcagctttttttcaccccgttattttatttctgatgaatacgagcggccttctcattcaaaacattgtcatgccgcttattttcctgtcagcgattttaagcatcgtcagcacgatgacggatcaatataaagtcacgcagcttgccaatctgctcagaaatatcgcgatcggcgcgcttgccgtatttctcaccgtgtttctcggcgtcatctccgtacagggggcttcggctgccgtgacggacgggattacgctcaggactgcaaaatttatcacaggcaattttattcccgtgctcggccggatgtttacggatgcgacggatacggtcatcagcgcatcgctcctattaaaaaacaccgtgggaatcctaggagtcggaattttgatctgcatctccgcgtttccggcgatcaaagtgctctcgctcgcttttatttataagctcgcggccgctattctgcagccgctcggaggcgggcccgtcattacgtgcctcggcgtcatcagccgaagcgtgctgtatattttcgcggcgctcgccatcgtctctctcatgtttttcctcagtattacagtcattattacagcaggcaacctcaccatgatgatgaaataaaggaggcccattggatatgagctttttaacagaatggctgacaagcattattttgtttatcttattcgccatcgtcatcgacatgctgctgcccagctccagtatgcaaaaatacgccaagatggttgtcagcctgctgttaatcattgtcatgctcaacccgatcttcaaacttttcaaaacagacccggaaatcatcttcgattatttgacaaaacaagagcaatctcaatccgctgatataaaaaatcaaatcaaatcagaaaaaaaagaaatacaagcatcaaaccgcgcatatgttttagaagaaatggctgtccaactaaaaaagaaagcggaggagatgttcagtcatgacgaatacaaaatagacgacatccgccttacagcggaagaacaggttcgttcagaagaagatgtaaaaacgatcagcgtgtatatggccccatcttctgaaaaaaccgtgcaaaccgtcgcaccgatcgacatccgcacagaccgcaaatacgaaccggaaggcgcagccgaaaaaaaagaggccgcagacatcaaagaaaaacttgcggatatatgggaaatcggcagtgagaaaattacggtttatatggaaggcggggagaaaaacggccatgaataaaaacggactatggaccatactcaaaaaacagctgatgatcggacaggcgaaagacggagaaaaaccaaaactgacaaaatatcattactttctgttcgtgtttgtgctcggagtatcttttatgctggtgagccagctgttctcttcaccggagaaaaccgggaaggaccaagcggcgcagaccgtcatgtccggccgaacggaagacaaaagcgggcaaaaaagcgcacccgtttttaaggcatcgaaagacagcagcgccaaaaacacgatcgatgattatgaaagagactatgaaaaccagctgaaagaaatccttgaaacgattatcggcgtggaggatgtatcaattgtcgtgaacgtagacgcaacatctttgaaagtgtttgagaaaaataaaacgaaaaaagacaccaccaccgaagaaaccgataaagaaggcggcaaaagaagcgtaaccgatcaaacctctgaagaacaaattgtcatgattcgaaacggggatcaggaaaccccggtcgtcgtccagacgaaaaagcccgatatccgcggtgtactcgttgtcgctcagggagtggacaacgttcaaataaaaaaaaccatcattgatgccgtcacaagggtgcttgatgttccgagctaccgtgtagcggttgcccctaaaaaaatcaaggaggattcataaatcatgctgaaaaaacaaacggtttggcttttaacaatgctcagtctcgtcgtggtattaagtgtttattatattatgtcgccggaaagcaaaaatgccgtgcagatgaaaagcgaaaaaagcagcggagaagtggcaactgaaaaaacgccggctcctgaaacgaaagataagaacggaagcggcacggataaagaagacggaacaaaaggaacgaaagattctaaaggcgcaaaagaggataaagaaacatcagccgaagcatcggacaaagacggatcggtcgctacagaaacagctgatgaaaacttatttaccgcataccgcatggaacttgaagacgcaagaagcaaagaaagggaacagttaaacagcattgtttcaagcgatgatgcgaccgcaaaggaaaaaagcgaagcctacgataaaatgacggcgctgagcaatgctgaagggacggaaaaacagctggaaacgctgattaaaacacaaggctacaaagatgcgctcgtggatgctgaaggagacaaaatcaacattacggtcatgtctgacaaacattcaaacgcaaaagcttccgctatcattgacctggtggaaaaagaaatcaagacgatgaaagacgtcgccgtcacgtttgaaccgacaaaataagagatctccaccgcccgcacccgctgcgggcttttctgatgtcattttagatcagtgttgaatttacacaagcgctcctgtaagataaacatagtatgtacttttagtagcaacccataaatttctattttttatacataggagtggaaactgatgttaaaaatcaacgaaattcatgaactgataaaaagaatcgatgaatcttccatcgacgaattcgtttacgaaatcgaaggcgtaagcctcaaactgaaaaaaaatgaagcgccggcagtgaatgtaacgggacaagctcaagccgttcccgccgcttacgcacctgctccgcaggctgcaaaaccggaagcgcatgaagccgctcctgttcaggaagcgccgaaacaagacgaaaacctgcacaaaattacgtctccgatggtcggaacgttttatgcttcttcatcgccggaagccggcccttacgtaaaccaaggttcaaaagtgagcgaaaatacagttgtttgtatcgtagaagcaatgaaactctttaacgagattgaagccgaagtaaaaggagaaatcgttgaagtgttagttgaaaacggccagctggtcgaatacggacaacctctatttcttgtaaaagctgagtaaggagacctgctattatgattaaaaagctattgatcgccaaccgaggagaaatcgccgtcagaatcatccgggcctgcaaagagctgggcattgaaactgtagccgtttattctgaggcagataaagacgccctgcatgtccaaatggccgatgaggctttttgtatcgggccgaaaacatcaaaagaaagctatttaaatgtaacgaacatcgtcagcgtcgcaaagctgaccggcacggatgcgattcatccgggatacgggtttttagctgaaaacgccgactttgccgagctgtgcgaggaattgaacgtaacgtttgtcggccctacggctgacgccatttcaaaaatgggaacaaaagatatcgcgcgcgacacgatgcagctggctggtgtgccgattgtgcccggttcaaaaggaatcataaaaaataccgaagaagcggtttcgcttgcaggtgaaattgggtatcctgtgattataaaagccactgcgggcggaggcggaaaaggcatccgggtcgcacgcacagaagaagaactgatcaaaggcattgagattacccagcaggaagccgctacggcattcggaaatccgggtgtgtacatcgagaagtacatagaagatttccgccatgttgaaattcaggtgcttgcggataattacggaaacacgatccatctcggagagcgtgactgttctatccaaagacgtctgcaaaaacttcttgaagagtcaccgtcacctgcgcttgattctgaaatcagggagcagatgggcgaagctgcggtaaaagcagcgaaggccgtcggttacacgggagccggcacagtagaattcatttatgactacagagaacagcgctactacttcatggaaatgaacacgcgtattcaagtagagcaccctgtcacagaaatggtgacgggaacggatctgatcaaagaacagatcaaagtggcatccggacaggagctttcgctcagacaggaagacgttgaatttaacggctgggcgattgaatgccgcatcaatgctgaaaatcctgcgaaaaacttcatgccttcacccggtaaaattaacatgtacctgccgccgggcggactcggcgtacgcgtggattcagccgcatatcccggctattcgatcccgccgtactatgacagtatgattgctaaagtcatcacatacggaacaacgcgtgatgaggcagtcgcacggatgaaacgcgcgctgagcgaattcgtgattgaaggtattgaaacgacgattccgttccatctgaaactgcttgaacacgaaacatttgtcagcggagagtttaatacaaagtttttagaaacatatgatgtaatgggctcataatttttgcgggaggtgaattgaatggaagacaacagtgtgcttaaaatggatcatgacgaggctcatttaggcaaggttgaaattgctcctgaggtcattgaagtcattgccggcatcgccgcttccgaagttgaaggagttgctgaaatgcgcggcaatttcgccaccggcgtcgtagaacgcttcggcaaaatcaatcacggtaaaggcgtaaaggtcgatttagccgatgacgggattaccatcgacgtctattgcgtcgttcaattcgggatctcgatcccgaaagtggcggcaagcgttcaggagaatatccgccaaaccttattaaacatgacgtctctgaccattaatgaaatcaatattcatatcgtcggcattcaatttgacacgaaagcccaagaagtcgaaatcgacgaagaaatgtaatgagcgtataaaaaccaaggggatgggcagccctttggttttttatacgtttcccgtcatttcaggcatgaagaaagccggcttacaaacggcagccgagtttcttcatgctgtgaaatccgaatgaaattaatacggtttgtgaaaatattcggcattagggtgaaaaaacctaaatttcgacatgcgattgagaaaaaaatatgttatgatctctttaagcttaacgacaagcggataaagcggatctgaaggagaaagaaaatgaaaagaagaacagctagagaaaaagctttgcaggcactttttcagattgatgtcagcgatattgcaccgaacgaggccattgagcacgcgcttgatggtgaaaaaacagatgccttctttgaacagctggtgtacggagtgatcgaacatcaggttcagcttgatgaaatgatttccggccatctcgtcaattggaagcttgaccggattgcaaacgtagaccgcgcgatcctgcgtctggcggtgtatgaaatggtttatactgacgacattcctgctaacgtgtcattaaacgaagcaatcgagctggcaaaacggttcggcgacgataaagctgcaaaattcgtaaacggggttctttctaacattaaaactgatatcgaatcataggaggaaagaaaatgactgcaacaatcatcgacggaaaagaaacggctaaagaaaaacgcgaacaattggcaaaagaagtagaagagctgaaagcacaaggcgtagtgcccggtttggcggtcattttaatcggagacgatcccgcttctgtttcatatgtgacaggcaagaaaaaagccgctgaaacaatgggaatgaaatttaaacttgaccgctttgactcaagcttaaccgaggcggagcttttaacagtgattgatcagtataatcaaaatccggaattccacggcattctcgtccagctgccgcttccggatcatatttctgaaaaagccgtaatcgagcggatctctcccgataaggatgttgacggtttccaccctctcaacgtcgggaaaatgctgcttggcgaagatacatttctaccatgcacgccgcacggaattgtcgagttattgaaaaagacgaacgtagatctttccggcaaagaagttgttgtagtcggacgaagcaatattgtcggtaaaccggtcggccagctgctgctgaacgaaaacgcgaccgtcacatattgccattcccgtacgaaaaatatgtctgagcatacgaaaaaagcagatattcttgtggtagcggtcggtaaagcgaatttcatcaaagccgatcaaatcaaagagggcgccattgtcattgatgtcggcgtcaaccgtctcgaaagcggaaaactctgcggagacgttcagtttgatgaagcgaaagaaaaagcatctttcattacgccggtgccgggcggagtaggtccgatgaccatcacaatgcttgcgcataatactgttaaatctgccagacgtacgttatcatagataaccggagacagtcacaaaaagtgtgacaatgagcacgatacccgcttcttaaggctcctttcagccagagcgggttttcttagtttagggcaaaaagcctttatgaaaggagtgcaggatgtgagtgaagcggcatatgtcacggtttccgcgctgaccaaatacattaaacgaaaattcgatgtggaccctcatcttgaagacatttggattaagggtgagctctccaatgttaaaattcatacgagaggccacatctattttacattaaaagatgagcatgcccgcatgcaggccgtcatgtttcaaagacaaagttcgaggcttgcgtttaagcccgaggacggaatgaaggtcatcgtaagaggcggcatttccgtctatgaaccgagcggaagctatcagctgtacgcgaaagaaatgcagccggacggtgtgggggcgctctacttagcatatgaagaattaaagaaaaaacttgccggcgaagggttgtttgatgaccggcataagcaggccatccccgcttttccggctacgatcggggtcgtcacgtcaccgacgggagcagccgtcagagacgtcattaccacactcaaaagaagatacccccttgtgaaagtcattgtgcttcccgcgctggttcaaggtgaaaatgccagcagatcgattgtgaagcgcattgaagaagccaatgcacaaaaaatgtgtgacgtcctgatcgtcggaaggggagggggctcgatcgaagaattgtgggcatttaacgaagaaagcgtagcccgggcgatttttgcttccgccattccgattatatcagccgtcggacatgaaacggattttacaatcagtgatttcgtcgcggatatccgggcggcaacgccgacaggagcggcagaaattgccgtccccatacgacggacttaatggaacggacaaaaacggcggaagtccggctgacaagagcgatgcagcagcatatcagcaagaaaaaagaacgggttctatcgctccagtcatcctacgcgttccgttttccgaaacgattgtatacccaaaaggaacagcagtttgatcttttgtatcagcagttccaatcacagctcacagggcttacggacaggaaacaaaggcagctggagcggaatacgtacagattaacggcgctccaccctgaaacccagctgaaacaggcgaaaaaacggtacgaggagcgctcaaatcagctcgcccgaagcatgaatgtccagctgaagcagcttcattcgcagtttcagacggttcttggtaaactgaatgcattaagtccccttcaggtgatggagagaggatacagtctggcctataaagataaagagctgatcaaaagcgttgatcaagtggaacaaaatgatacgcttgaagtaaagatgacagacggcgttctgacgtgtgaagtattgcaaaagagaggcgaacgaaaatgacagaaaccaaaaaaagtgaagagctgacatttgaagaggcgatgaaaggccttgaaggcattgtggcaaagcttgaagaaggagacgtgccgcttgagcaggcgattaattattttcaggaagggatggccctttcaaaaatgtgccatgaaaagcttcagcatgtcgaaaagcaaatggactttattttaaaagataacggcgaacttgcacctttcagcgttcaggaggaagacgaaggtgacaaataaactggacgcatttttagcatcgcgcaaaaaactgattgaacagcagctttctttgtatacggaacggcttgcgatgcctgaaatcctcaaaaaatctatgctgtattctttggaagcgggcggaaagaggctgcgccccctcgtcgtcttagccgttctgaatgcttacggaaaagatgaaaaagacgggattccggtcggatgcgctgtcgaaatgattcatacgtattccttaatccatgatgatcttccttgcatggacgatgatgatctgcgccggggaaagcccacaaaccataaagtcttcggagaagcggcagccgtattggccggagacgggcttctgacagaaagctttaaattgatcacatcccacgtgtctgaggcggtttcagcagaaaaacggctccgtctcgtcgatgagctgatcagcgcggcaggaacggaaggaatggtcggcgggcaggctgccgacatggaagcggaacaaaagcggataacgcttgaggagctggaatccatccacgagcggaaaacggccaagctcctcggtttttctgtgacggcgggcgccattttggcagatgcgccggaggatgaagtcgaaaagctgcgtctgttcagcagccatatcggcatcggatttcaaatcagagatgacatccttgatattgaagggcatgaggagaagatcggcaaaccggtcggctcagacacgtcgaatgaaaagtcaacgtatccgtcgcttttaacgcttgaaggcgcgaaagagaagctggcgtatcatatcagcgaggcgaaacggatcatcagcggcctttctcttcagaaagaactgctgcatgacctctgtgatttaatcgcggcgagagatcattaaaaacggtcctgatttgaaggggctgccgctcctatggtaaaatgtaagcagtttcgatgaaaatacaaagggagtctttttcttttttcaaaaagacactgtttaatttgcagaaattcatgctgaaagtgagttgatccgctttggatcttttatcaatacaggacccgtcatttcttaaaaagatgtcaattgaacagctggaagagctgagtgaggaaatccgcaatttcctcatcacatcgctgtctgcctctggcggccatatcgggccgaacctcggggttgtcgagctgacaattgcgcttcacaaagaatttgacagtccgaaagataaatttttatgggatgtcggacatcagtcctatgttcataaactgttaaccgggcgcggcaaggagtttgaaaccttgcgccaatataaagggctttgcggtttcccgaagcgcagcgaaagcgaacatgacgtatgggaaacaggccacagctcaacatcgctctcaggcgcgatgggaatggcagccgcccgtgatattaaaggatcgaaagaatatatcatcccgattatcggagacggcgctttaaccggaggaatggcgctcgaagcgctgaaccatatcggtgatgagaaaaaagatatgatcgtcatcctgaatgataatgagatgagcattgcgccgaatgtcggggcaattcattctatgctgggacggcttcgcacggccggcaaatatcaatgggtaaaagacgagcttgaatatttatttaagcgcatcccggccgtcggcggaaaattggccgccacagcggaacggataaaagacagcttaaaatatatgcttgtgtcaggcatgttttttgaagagctgggctttacgtatttaggccctgttgacggtcattcctaccacgaactgtttgaaaacctgcaatacgccaaaaaaacgaaaggtcctgtccttttgcatgtcattacgaaaaagggcaaaggctataaaccggctgagaccgacacaatcggcacatggcacggaacggggccttataaaatcaatacgggtgatttcgtcaagccgaaagccgcggcgccttcatggagcggacttgtcagcggcaccgtgcaggagctggcgcgcgaggatgacagaattgtcgcgattacaccggctatgccggtcggctctaagcttgaaggatttgcgaaagaatttcctgagcgcatgtttgacgtcggaatcgcagaacagcatgcggcgacaatggccgcgggaatggcgcttcagggtatgaagccgtttcttgcgatttattcgacctttttacagcgggcgtacgatcaggtcgtccatgatatctgccgtcaaaacgcgaatgtatttatcggcattgaccgcgccggtttggtcggcgctgacggggagacgcatcaaggcgtctttgacatcgcctttttgcggcatataccgaacctcgttttaatgatgccgaaggatgaaaatgaaggccgccatatggtcaatacagccctttcatacgaggaaggtccgattgcgatgcgcttcccgcgcggaaacgggctcggcgttaagatggataaagagctgaaaaccattccgatcggaacatgggaagtgctccgtcccggaaaagacgcggtcattttaacattcggtacgaccattgaaatggcgctggaagcggctgaagaactgcaaaaagaaggcctgtccgtgcgtgtcgtgaatgcgaggttcataaagccgattgataaacaaatgatgaaggccattcttaatgaaggtctgccgattttaacgatagaagaagctgtgcttgaaggcggattcggcagcacgattcttgaatacgctcatgacctcggcatgtatcatacaccgattgacagaatgggcatcccagaccggtttattgaacacggcagcgtaaccgccctgcttgaagaaatcggtctcacgaaggctgaggttatgaatcggataaaactgctgatgccgccgaagacacataaaggaattggatcatgacagcaaaaaaagaacgattagatgtacttcttgtagaaaaaggccttgcggaaacgcgggaaaaagcgaaacgcgccattatggcgggcatcgtatactcaaatgaaaaccgattggacaaaccgggtgaaaaaatcgcccgggatcttccgttaacggtaaaaggaaaccctcttaaatacgtcagcagaggcggattaaaacttgaaaaagccttggaagtgtttcctgtctcggtaaaaggcaaaacgatgattgacatcggctcgtctacaggggattcacggattgcgccctccaaaacggagctgagcggtcctacgcagtggatgtcggctataatcagcttgcttggaagctcagacaggacgagagggtcgtcgtcatggaacggacgaatttccgctattccgagccttccgatttcacagagggtttgccggaatttgcgacaatcgatgtttctttcatctcactccgcctcattctgccggttttaaaaacgctgcttgtaccggggagcgattgtatcgcactggtgaagccgcaatttgaagccggacgggaatccgtcggaaaaaaaggcattgtcagagatcccggcgttcatgctgacgttctccgccgcatgaatcaatttgccgcttctgaaggatatacagtgaaaggactgtccttctcaccgattacagggggagacggcaatattgagtttctgcttcatctggaatggggcggagaagacggaaacggcgctgaactgccggaagaagatattctccgtatcgtccgcgaagcacatgagacattaaaagccaaaaagacagatgtaccggaataatagggggctattattccttttttctgccatcatgtactttttatcaagaagcggttaacataatgacaagaacagcttgaaaacagaggtgcttacatgacaaaaggccaaaggcatataaaaatcagagagcttattacaagccatgagattgaaacgcaggatgacttagttgacatgctgagagaagaaggatataaggtaacccaggcgactgtctccagagacattaaagagctgcatctcgtaaaggtgccgacgaacaacggctcctacaaatacagcctgccggcggatcagcggttcaatccgctgtcaaaactgaagcgttcattaatggatgcgttcgtaaaaattgactcagcaagccatatgatcgtattaaaaacgatgccggggaatgctcaggcaatcggcgctctgatggataatctcgaatgggaagaaatcatgggcacgatctgcggagatgacacgatcttaatcatctgcaggacgcctgaagatacggaaggcgtacaaagccgtcttttggagctgctgtagcgtaattatcagataaaaggtggaatgctgtttgttagctgaactatcaataaaaaactttgccattatagaggaactgacgatttcgtttgaacgggggctcaccgtcctgacgggagaaacaggggccggcaagtcaattattatagacgccgtttccctattagtcggcggacgcggctcgtccgaatttgtccgttacggtgaaacaaaggccgagcttgaaggactgtttctattggacagcggtcatcccgtttttgaagtatgccgtgagcagggaatagacgcatctgacgacatgattgtcatgagaagggacatcaatgccggaggaaaaagcgtctgccgtgtcaacggaaaattagtgacgattgcggctttaagggaaatcggcagacttttattagatattcacggacagcatgataaccagctgttaatggaggacgacaaacacttggagcttttggataaatttgcgggcgctgaggccgaatccgcgcttcaggcttaccatgaaggctatgagcgttatatggagctgctcaaaaaagtgaagaagctgtcagaaagcgagcaggaaatggcgcatcggttagacctgattcaatttcagcttgaagaaatcgagtcggcgaagcttgaattgaatgaagacgaacttcttcaggaagagcggaagcagatatccaactttgaaaaaatttatgaatcattgcaaaacgcctataatgcgctccgcagcgagcaggggggcttgactgggtcggaatggcctctgcccagcttgaagatatttcggatatcaatgaaccgctgcaaaagctgtctgaaagtgtgtcaagttcctattatctgctggaggatgcaacctttcaaatgcgcaatctgttagatgatctggaatatgacccggaacggctgaattttattgaaacccgtttaaatgagatcaaacagctgaagcgcaaatacggagcgacggtagaagacattttggaatacggctctaaaatagaagaggaaatcgatcaaatcgagaaccgcgacagccaccttgaagccctgaagaaggaattggagtcggtcggcaaagatgtggccgtagaagccgccaatttatcaaaaatcagaaaagcatgggccaagaaactggcggaagcgattcatcaggaattacaaagtctgtatatgggcaaatcaacgtttgatacggaatttctcgtgaaaaccgatccgtcagccagtgaagcaccggttgttaacgggcagcccgtgcagcttacccaaaaggggatcgaccttgtgaagtttttaatttcaacaaacaccggtgagcctttaaaaccgctgtcaaaggtcgcttccggaggcgagctttcaagggtgatgctggcgatgaagagtattttttcttcccagcaggatgtcacctccatcatctttgacgaagtggacaccggtgtaagcgggcgggttgcccaagccatcgcggaaaaaatccataaagtatcgaccggttcacaggtgctctgcattacacacctgccgcaggttgccgctatggcggatacgcaccttctgatcgcaaaagaattcaaagacggacggacgacaacgcatgtcacgccgctttccaagcaggataaggtagcggaaatcggccgcatgattgcgggtgttgaagtgaccgatctgacaaaacggcatgcacaagagcttttaaaacaggccggacaggtaaaaacgacaggataagctgctgatacaggcagcttattttttgttccatttctctaacagtgtatccaatgtttttcttcgtatgccggttataaatcaagcgcaggaaggcaaaagtatagatgtagcagaaaaagaaagtggtgtgggataggagcgaggagagtgaaggaatgaatgcacgataacatgaggaaagcaataggtgtaattctccttgtttctttactaagtgtaggcttttttaagccgtttaaagaatatttactgataccgtcagaaatgagcgtctttgaaaaccagacacaggccgttccggtcaatgcatcaataagcgctgaaaagggcgaattatcagaagcctttacgctgaaagaagagcacggtcatgcaaacataacagggcaaacacaaggcaggtcagaagtagtatatgatcttgccggatttcccattaaaaaaacgaaagtgcgtgtccttcctgaattgaaggtcattccgggcggacagtccatcggtgtaaaactgcattcagtcggtgttttggtcgtcggttttcaccaggtgatgacaaaggatgggaaaaagtctccgggagaacaagcgggtattgaatctggcgacatcattattaaaatgaacggacataaaattgaaaaaatgagcgacatcgccccgtttattcaaaaagcgggcaaaaccggtgaatctctggatttattggtgaaacgcgataagcaaaaaatcaaaacaaagctgattccgacaaaggacgaagccgaggggaaatatcgaatcggcctttatatccgtgattcggcagccggcatcggcaccatgacattttttgaaccgaaaacaaaaaaatacggcgcattgggccacgtcatctctgatatggatacaaaaaaaccgattgttgtagaagacggagaaatcgtccgttctactgtaacatcgattgaaaaaggaaaaggcggcaatccaggcgaaaaactggcaaggttttcgtcagaacggaaaacgatcggcgatattaaccgcaacagcccgttcggcatttttgggacactgcatcagccgattaaaaacaacatttccgacaaagcgcttccgattgctttgtcaaatgaagtaaaaaaaggacctgcgcaaatgctgacggttatcgaaaacgataaagtagagaaatttgatattgaaatcgtcagcaccacgccgcaaaaattcccggcgacaaagggaatggtattgaaagtgacagatccgaaactgctgaaaagaaccggcggaatcgttcaggggatgagcggaagcccgatcatccagaacggaaaggtcgtcggagccgtaacccacgtatttgtcaatgatccgacaagcggctatggcgttcatatcgaatggatgctgtctgaagcgggtgttgatgtttacgggaaagacaaagcaagctgactgccggatgatccggcagtttttttatgtgatgcgttcttcacttctttccgggattcatgtaaaataagacatgaagatttttcgacaaattcacgtttcctgatttgtcaaacttaatttttagtcgaaaaacctagaaaatgctagaaaaacaaagatataccactattattggtaaatatggattttttaaaaggggaagtagtggttttgtcgaatgtaacatatagcagtcaaatgggttgcgtcctgttaatacattgggggaggaagaaacgtggagaaaattaaagtttgtgttgctgatgataatcgagagcttgtaagcctgttgagtgaatatatagagggacaggatgatatggaagtgatcggcgttgcttataacggacaggaatgtctttctttgtttaaagataagaatcccgatgtgctcgtgttagacattatcatgccgcatctggacggacttgcggttttggagcgtctgcgtgaatcagagcttgagaagcagccgaacgtcatcatgctgacggcattcggtcaggaagacgttacgaaaaaagccgtcgatttaggcgcatcctatttcatcctgaagccgtttgatatggaaaaccttgtcggccatatccgccaggtaagcggaaatgtcagcagtgtcacacaccgtgcgccgtctgcgcaaagcagcattatccgcagccagccggagccgaagcggaaaaatctcgatgccagcattacaagcattatccatgagatcggtgtgcctgcccatatcaaaggctatctttatttgcgtgaagccatttccatggtgtataacgatattgaactcctcggcagcatcacaaaagtcctttatcccgacatcgccaaaaaattcaacacgaccgcaagccgtgtagaacgggccatccgccacgccattgaagtcgcatggagcaggggaaatattgattccatttcttcactgttcggatatacggtaagcatgacaaaagcaaaaccaaccaactcagagttcatcgcgatggttgctgacaagctgagattggagcataaagcttcgtaacgcaagcctttggctaaatgtctttttgcgccttctattccgtgcatgaacgcggaagagaaggcgttttgagattttgctgacgaaaacaatgggaaccactcacgccggtacttgttctatacataaatacgggaactgccgtctatacgtataataccggagctgatattttaatgattttgccgtctctgaaataaaagcgggggatgcggcggcttaacacagaaaggacttcgtagctgatcgtaccgagcatttcggcaatttcatcaacggaaatctcggctccttgttgtttgccgtagatgacgacttcttctccttgtttgccctcattctcacctaaactgaccattatcatatccattgtcactctccccgccaccggcacccgtctgccgcggtgcagaataaacccgcggttggacagggcgcgggagtaaccgtcagcatagccgatcggaatcgtcgcgatgatttcacccggttcggcgatatatgtggcgccataactgacggtccggggatctgtcaccatagctttcacataagcgatacgcgcctttaaacttagtgcgggtgtgagatccacgaggttcagttcctttatcgaggcggacggatataaaccatataacccaatacctaaacggatcatgtcggcgctgaattccgggaatgcgatagcggcggctgtattgcacatatgcacggtaggcagcgtaatgtcttgattttttaaaaagcggagaaagctgataaacttttcgtgctgcagcatcgtcagctcagtgtccggttcatccgctgttgaaaaatgtgtaaagatgccatcccatgacaggtatgtactcgacttgagcgctttcaccactgctaaaagatcttcttctgtgcgcacacccagccggcccattccggtatccacattgatatgaatggacagccgtttcgactctgcttctttttccaatatccgattcgcttttttgatccagctgacctgaaacgctgataatgtgatgttccaaacggcagattttttcacacagctgagagctgtgaagccgagcacaagaataggcgctttaattcccgctctccgtaacacaattccctcttcgacgctggcgacagcaagctcgctcgccccgctttccagtgcctgccgcgctacttccacagagccgtggccataagcgttcgcttttacgacggccataattttagacgtattcggaatatggcggcggatcgcccgtacgttcttttttatcgcatcaaggtcaacttcaatccaaacttcccggcaaagttttttcatcacgattccttctttccttaatgagattcagtactcatgctttcaatctgcattctattcatctttaactgaaatcattcaaaacatgagaaggtgaccgctgatgtttaaaatcaagttttcgggaaagcatgcgcctgctttatttatgcagtaagggcagcatggcggcccttacaatgactttacaatattctgatctgaaaattgatgttcaaacattttggactggcttacagcattgttttgaatgacaatgccgatatttccccctccggcaccgaaaacggtttttgatgcagtcagcggactgatggatatggcgccgccaacattgacaactccgtttcctgatacgttgtttatcgtaatcgggcaaccgctcattctattttttctcctttctctcacagtctactaactatatgtacgctgtgatatggaataagattaaacaaaacggcaaaaagaatccggctgctgccagccggaaagggagggaaatacggatatcataatgttttcgttacattttgatcagagtattgagagtttgaagattgagatgtgctggattgattcatttgcaggaccatacctgtatttccccctcctgagccgtagacggtttttgatacggttaaaggacttatcgaaaacgcaccgccgacattgacaaccccgtttccggaaagactgttaatcgtaatagggaaaccagccatcatatacggtctcctttctattaatctatttactatatgtacgctgtgtgttagaaataggagtaaacaaagcggtaaaaacttgtgaatcaaaaaaactgccggacatccggcagttttttagtctacttttcaaacggcacccagccgcctgtattctgaatcatttcccataacggttcaggaagtcggtatttatcaatttcagatgcctgaatggctttttcgatttcctgttcgcggccttctttgaccagcaccgcccattcggggttaatcaaaatgacacgtcccagagccaccagcggaattccgctttctaatacggcaagcgcttcgtccgcggtatagatggaaccgacggccatcagcggcactttatggccgacgcgttcgtttaataaatccatccgggtccgtgaagtatccgcgccgcggcgggctttggaattgacatccatcagtgaaatatgcagataatccaagttctcttccgcaagcgcgtcggcgagcatgaatgtttctttcattgtaagccccggtgtttccggctcttccggtgacaggcggtagccgagaacgaatggattttcagcgtgtgtatcaatcgcctgtttgacagcgtcaacgactgcaagcgggaacgcaaggcgcttttcatcgcttccgccccagcggtctgtgcgccggtttgttttcggtgaataaaattggtgaatcaggtacccgtttgccccgtgaatttcaacaccgtcaaagccggcttcaatcgctctgcgtgtcgcttcgccgaatgctttcacgatgtgctcaatttcttgttctgtgagagcacgggacgtttgtctgccgtcttcttctgagccgctcggactgacgacgtcgttgtttggcacgagttcaggagggcattccaagcctccgtggtgaatctgcacaacggctttcgctccttgagactggatcgcctgagcgagttttttcaagccgggaatgtgagaatcatcatagatgccgggctggcctggaaacgctttgccgtccggcgttacgtttgcacatgccgtaatgaccatgcccatttcttttgaacggggagtaatgtagcttaattcacggtcggaaatcgttccgtcatcatttgatgaatagtgtgtcatcggtgcgactgaaatacggtttggtatagtgacaccgctttcgaacgtaaaaggttcaaacagcggtttataagtttgcttcatcatttcgccttcttccttaggagtttaactcgtccgtattctagcttatgttttcattgtgtgcaattattttgcttgttcttcttcctgaggttatgaccggctgaaccatttaaacgaatgaaacggttttctccgttccttttcaggatctttatatcctcctgaaatttgatggccgatcgagctgaatatgacagcggcggcgaagaggagaatgatttttttcatatgcatatcttctttcttatcttttacatggttatttataagcatacgcttgtgcgaaaaaaccgtcaatttgtttattcttttttccactttcctgcggcgaatatcgttccgatctgaatcacaacacttaacagagcgcacactgccacaactgtgttgctgtccatagaagacaccctcctttttgttaggttgatgtatcatatgacggctgtctctgttttgacaaaaccgtaatgcggtgtttcatatttttcaacacaaaaagggcgcttttttaagcgcctttacttttttttcagccggttcaaagcgatttgaacggcgatggcgtcatccaggtagccgatcggaaacatgtaatccgggataacgtcggtcgctaaaatataatacagcagcgcgctcccgagaatcgcgcggtcttcagccggtgttgattcatccatatactgatgatgcatgtttttcaaatggtcaataaaagggccgacgctttcttcattgtccattttcttttgaaactcatcgcaaatcaggcgatggccctgctgggttttggcgtattgttcatatctggtcagttcacgctcaatttgctcccgggaaaaaggctgatcaaacatctcggccatattcagcatatcctgaatcgcgtgcatcgggtcttgcggcgcagcttctttttcatggccgatgtctatgcctgacgcctcaagcaattcctccagcggggtgcggaggtgttttgaaaattcctgaagatgctttaaattggccttctgtttgccgttgataatccgggagatagtggccgtatcaatgtttgttaaggcgccgagttttctcatggagagcgagtgcttatcaagcagtgattttaaaaggggtcccagtgtcttatttttattttctgtcaagggtgtcacctcgtttccgccggaatgatgatcgtcaatcaataatttttgcagaaaaggtaccttttctgtgctgctgaataggatagtgtagattcaacggcacaacatgttgaaaagacatcaaagaatggagagaaacgaacatggcttggttattgattttaggtttggcagtgtcctcaagcattgataatttaggagtggggatgtcatacggcatcagaaaaatcaaaatatcgcatgcgtcaaatatgatgatcgcttttatctgttttgtattcagttatatcggaatttatttcggcaaatggatttcagccgttttaccgggctttcttcctgtattgctggcggcgtttattttatctgtcatcggtatccgcatcattctgctggctgtgccgagaaaaacagcgcgtgttggcgggtcaggaaaaaaaggccgttttgccggtctgctgcaaaatccggaggcagcggatgccgacggttcgggagaaatcggtatattggaatccttggttctcggggtggccgtatccgcaaatgcgctgaccaacggattaagcgcggggttgatcgggctttctcccgctgccatttccattactgcggcggtcggaagctttctgaccatatggatcggctgctcgcttggaaaaaaagccgcttcattgcgcatcggttcttttcacgtcggacagttcagcacggtgctgagcggagtgattattctcatcattgccgccaatacgctgctcttttaagttgtcccgttcattttatgaaaagctcaaaataaatatgaatgtttctattcgggagagtgcatgacgcggctctcttttttgccgatctgatattttttcaaaatgaacagaaagtcgtccgtttccgttaaattctgcatattcggccttcagacagaacctttttcatagactgatcagcttgttttctttctaagttcaggtaaacagcaggtcagatagccttcattccaaagatggaaaaacgctggaggaatggaggctccctttacaaatcggccattctgttcaaagataaagccgaatgagaaaacgtgaggtgatctgtgtgaagtctgccatacttctgatcttcaccgcatggctgttatcaggctgcgagtataccgcggaggctgatgcggcgccgtcatttacacaggaaggaacatttataaaagcggccggaaacgatacgatcgcggtcgaaattgacggagaaaggcaagaggtgaaggtgcctttcgctaagcggtttgaatgtcagtcgctgcctgaacatacggcggtgcaaatcacctataaaaaagagagcaacggacaattacggcttgagaaactgaaaaaagaaacagatatgtgaaaacggggaggaaaaaaacgtgggtttactgacaaaaagcgctgctgccttcggtgccgctctgcttctgcttgcgccgtccgcttatgcagccgaacctttgcaagggaaaaccatctatatagatgccggacatggcggagaagacagcggggccggcggaaatggactgcttgagaaaaacatcaatttagcggtgtcaaacaaggtgatcgccaaattggagacagaaggcgcaaaacctgtagcttcaaggactgatgatacttttttacgtttggacgagcgggtggcgaaagcgagcgccagccaatccgatttattcgtcagcctccataccaattcagccgtatcaacggcatcgggcgcggaaacgtattttaattcgacatatgaaggagcggacagcgaaaggcttgcttccgacattcagcagcagcttgtcacgtctttagggatgagggacagaggcgtaaaagaagctcctttttatgttattacatattcaaagatgccgagtgtgctggctgaattaggttttatcacaaatcctcaagatgcggacaagctgaaaagcgataacggacaagagcacgccgcggacgccgttgtaaacggaatcgaaacctattacagcggacggtaatgataaaatatgtgtaaatagcgccctcctgatgtgcataacgattataatagagaaaaccgatgacaaacatctgaggtgacacatatgacgaatatttttgcccaccggggggcgtcgggcgactgccctgaaaatacgatgcccgcattcaaaaaagcgattgaggacggggctgacggaatcgaacttgatgtacagatgacaaaagacggccggatcgtggtcattcacgatgaaaccctcgaccgcacgacatctttgaaaggatttgtgaaagatacggcgtatgacaaaatcagaaccgccgatgccgccggaaaatggaaagattcttttaaaggtgtcagaattccgcttttgtccgatgtgctgcgttttgctgaacgtgctgattttctgataaacattgagctgaaaaacagtgtattccgttacgaaggaatggaagaagaagtgatcaaaaaagtcagatattacggactggaaaagcgcgttattttttcttcatttaatcatgagagtctcgcggtgtgccacgccctggcgcctgaaattgaacgggcggtgctgacaatggatgtgctgtaccggcctgaacgttatcttgccgccattcccgcttcgggttatcatccgaagctcggcacgccggcggtcagcgctgaagtgatcacacatcttgcaaaacaccaagcggcgctccgtccgttcaccgtcaatcgtcctgaggatatgaagcggctgatgaaagcggggatagacgcgatttttacagattatccaaagctggctgtttctataaaagaagaatgccgcagctgagaagactggtcagacagtcttctttttttatgggcgggaaaaaggcggtgcactcataactcggtcagccggttcatatattgtaacagggcgttttgtgtaagcgttatcttttatcttattgaaagtgaggcaaaattgtgggaaaaacggttatcgtcagtgcggcaagaacgccgttcggaaaattcggcggcgcattaaaagaggtgaaggcatccgagcttggcggcattgccataaaagaagcaatcaagcgcgccgctatcagtgaaagcgaagcggaaggagcggtgatggggatggtcgtccaggcgggtgccgggcaaattccggcacggcaggctgcaagatatgccgggcttccgtggtctgttccggctgaaaccattaataaagtctgtgcatcagggctcagagccgttaccatctgtgatcaaatgatccgggcgaaagacgcggacgtgctgattgcaggcggaatggaaagcatgagcaacattccgtacgccattccggccggccgctggggtgtgaggatgggggacggggtttttcaggatttaatggttcatgacgggctgacctgtgcgttcgaccaggtgcatatggctgtccacggaagcactgcggccaaaaagtacggcatttcccgagatgaacaggatcattacgctcttttgagtcagaaacgcgcggctgaggcggctgatgcgggcaaattgcgtgaagaaattgtccccgtcacctggaccggcaaaaagggcaaacagcatatcgttgaagcggatgaggggctgcgtcctgatacaagccttgagcagctcgcagcgctcaagccgattttcacagccgacggaacggttacagccggaaacgctcccggtgtaaatgacggggccggagcatttgtgctgatgtcagaggaaaaagcagcaaagcagcatgtcaggccgctcgcagcgatacttggctttgcgtccgtcggactggaagcgtccgagctggcaagcgcgccgggagaggccatcagccggctcttgaaaaaaaccggactgtccgttgacgatattgatttgtttgaagtaaatgaagcatttgcgtccgtcgtgctcgtgagtgaaaaaatagccgggttcagccgggagaaagtgaatgtaaacggaggggcaatcgcgttcggccacccgatcggcgcaagcggagcgagaatcgtcatgagtttaatatacgaattaaagcgtcgcggaggggggttaggcatagcggctatatgcagcggagcggctcaaggagatgccgtcctgctggaggtgtactgatcaaaggagggagcgccggatgaagatgaaaacaatcatggtcgcaggtgccggtcagatgggggcaggcatcgctcagacggctgcagaagccgggtttgccgtcaagttatacgattgggagccggaaacggtaacaaaaggtcttcaccgcataaagacaaacctggagaaagagcaggcaaaaggacggaagtcacagcaggagacagatgccgttttcagccgtatttccccggcggagctcacagaagcgggagatgctgattttatcattgaagccattgccgaaaacaaaaaagcaaaagcggaattgtttgacacacttgataaaatctgtccccctcatgccgtattggcaagcaatacgtcttctcttcctattacggagcttgccgcggccacaaaaaggcctgaaaaagtaatcggcatgcattttatgaatccggttccggtcatggagcttgtcgaagtcatcagaggactcgccacatcggaagaaacggcggaaacagtaaagaagcttgccgtccggatgaataaaacccctgtcgaagtcaatgacttcccgggctttatatctaatcgcatattaatgccgatgattaacgaagccgtttattgcctttacgaaggagcagcttcaaaggaagcgattgatgaggtgatgaagctcggcatgcgtcatccgatgggtcctttaacattagctgacttcatcgggctggatacgtgcctttccattatggaggttctctacgcggggctcggagatccgaaataccgcccatgccctctgctcagaaaatatgtcagcgccggctggctcggcaaaaaaagcgggcgcggtttttatgagtacggcagatgacgtaaagatcatgaggggagacggcagccatgcattttactgaagagcacatcatgatgaggaaaatggtgcgtgattttgcccgcaaggaaatcgcaccgatggttgagctcatggaatcaacagatgaatttccggagcggctgattaaaaaaatgggcgaagcgggattgatgggcattcccgtcccggaagcttacggcggggcgggtgctgatacaacatcttacattttagcgattcatgaaatatcaaaagtcagcgcggccgtcggcgtcattttgtccgtccacacatcggtagggacaatcccgattttgcatttcgggacagaagcccaaaaacaaacgtatattccgaagctggcagcgggcgaatatattggagcttttgcgcttactgagactcactccggatctgatgcgggaagcctgaaaacaacagccgtgcgaaaaggcggttcatatattctgaacggttcaaaaatctttattacaaacggcggagcggcagatctgtatctgacatttgccgtaaccgatccgggtaaagggagaaagggaatttcagcgtttattgttgaaaaaaacacacccggtttttctgtcggaaaaaaagaaaaaaagctcggattgttaggttccaatactgccgaattgcagtttgatcaagcggaaattccgattgaaaaccggctcggcgaagagggcgagggtttttcaatcgccatgaaaaaccttgacgtcggacggatcggcatagcggctcaggcgctcgggattatcgaagcggcgctcggctgctcggcggagtacgccaaaacccgcagccagttcggcagacccatcgcttcgaatcaggccgtttcatttaaattatctgacatggcaacgaatgcggaagctgccaaattattggtctatcatgcggctgatctgtatcagcgagggcttccgtgcggaaaagaagcatctatggcgaagcaattcgcgtccgatgcggcgatgaaagcggcggtggaggctgtgcagattcacggcggctacggctatatgaaagagtatcccgcggagcgtttatttcgggatgcgaaagtcacgcaaatctatgaaggaaccaatgagattcaaaggctgattatttctaagtatcttcttcaataaaaagtgcgcaaaggagcgaaactatggaatcttattctcccggtttagatggcgtcattgcggtggaaacggggatttctttcctggatacacagcagggcagtattttaatcaaaggccacgatctgattgagctttctaaaacggccggctatatggacattgttcatctcttattggaagacagacttcctgatgcgaaagagaagaaggcgcttgaagaagacgttcggcgcggcggacaccttcccgaggaaatcttgcgtatatgccgtctgctgcccgaacgtactcacccgatggacggactgaggacaggtttgtccgcgcttggaggctttgataaggatattgataaccgcacctcttctgtaaatcggcaccgtgtccgcgggctgataggcaaaatgcccaatctgaccgtcaacagctatcgagtcatcaacggactggagcctttagcgcctgtcggaaccttgtcgtacagcgcaaactttttatatatgattaccggaaaaacgccgtcctccttggaagaagaaatattcgaccggtcgcttcttttatacagtgagcatgaattgccgaactcaacgtttacggcccgtgtcattgcttcgacgcaatcggatatttacggcgctctgaccggagcagtcgcctcgcttaagggaaaccttcacggcggagcgaacgaagcagttatgtacatgcttgaggaagcgaaggatacagacgggtttacacaattattaactcaaaaactcgcaaacaaagaaaaaatcatgggcttcggccaccgtgtctacatgaaaaaaatggacccgagggcgctcatgatgaaagaagcgttgaaaaaactgtctgatctttcaggtgatttccgtctttatcatatgtgtgaagcaggagaaatcgtcatgcgggagaaaaaaggcctttacccgaacttagattactacgcagcgccggtctattacatgctcggcatcccgatcccgctgtatacgcctatattcttcagcgcacggacggtcgggctgtgcgcccacgtcattgaacagcacagccgaaaccggcttttccgcccgcgtgtccgctataccggagcgcgtctgtaaacagatgagaaaggaagatgaaaacatgacagaaccccgccgaatggacgccgtaatcgaagagatttctgactacgtgctccatcaggagattgacagttcggaagctttcactacggcaggacatgtgcttcttgatacgataggctgcggaattttggcgctcagctatcccgaatgtacaaagctgctcggcccgattgtcccgggaacctccgtgcccaacggcagcagagtcccgggcacgccttttgttttagacccggtcacggctgcctttaatatcggctgtatcaacaggtggctcgattataatgatacgtggcttgcggccgaatgggggcatccgtctgacaatctcggaggcatattggcttgtgcggattatatatccagagtgcggatttcagaagggaaagaaccgcttaccgtgcgtgatgtgctttgcgcaatgatcaaagcgcacgaaattcaaggaattctcgctttggaaaacagtttaaacagagtcgggcttgaccatgtgctgtttgtgaaggtggcgactgcggctgtttgcgcacaaatgctgggcggctcaagagaggaaatcaataacgccgtatctcacgcttggattgataattcaagcctcagaacgtatcgtcatgcgccgaacaccggatcacgcaaatcatgggcggccggcgacgcgacgagcagaggcgtatatttggcccttatggcgcaaaaaggtgagatggggtacccgacggctctgaccgcatccgggtggggatttcaagacgtattatttaaccggcaggaaatgaagcttgcccgcccgcttgggtcctatgtgatggagaatgttttgtttaaagtatcctatccggctgaattccacgcccagacagcggcggagtgcgcggtccggcttcatccggaggtgaaagaccgcatcgaagacattgacaggatcacgattatgacccatgagtcggcaatccggattatcgataaaaaagggccgcttcacaatccggctgaccgggatcactgcctccagtatattacggcaatcgggctgcttttcggagatatcacggcggatcattatgaagaggaaacggcgtctgacccgcgaattgatacattgcggagcaaaatggaggtgacggaacataaagcgtactcaaaagattacttagacccgaataagcgatccatctcaaatgccgtacaggtgcattttacagacggcacggctacgggacggattgaatgtgaatatccgctcgggcaccggttccgcagaaaagaagccgttccgaagattcttgccaagttttcagcaaacatcagcactcatttttcattgaagcagcagcggaaaatcgaagaggcctgtaaagatagcggccgaatgcagaagctcagcgttagtgaatttatggacttatttctcatataaaataggagggtgacaaacatgacgtggatcgtcagcaagcagtcgtctcaagaggagcttgcagagcggttccgtacgctgatggcagcgccggatctattgcagattccaggcgctcacgatgcgatggccgctcttattgccaagaaaacgggtttttcggctctttatttatcaggcgcggcttacacggcgagcagagggctgcccgatttaggcatcatcacgtcggcggaaatggctgaacgggttaaagatctggtccgctcgtctgatctgcccgtccttgtcgatattgacacgggtttcggaggcgtgctgaatgccgcccggacggcgaaagaaatgtatgaagcgcgcgcggccgccgtccaaatggaggatcagcgcctgccgaaaaaatgcggacatctgaatgggaagcagctcgtgccgattgaagaaatggcgcaaaaaatccaagcggtcaagcgggccgcgccgactcttcttgttgttgcgagaacagacgccagacagcaggaagggctggagggggcattaaaaagggcgtccgcttatataaaagcgggtgctgacgctgtttttccggaagcgctccaatacgaaagtgaattcagagcgttttccaaacaaatcagtgtgccgattctcgcaaatatgactgaattcggacaaacgccgtattacagtgctgatgaattttccgatatgggctgtcagatggtcatttacccggtcacgtcactcagaacggctgccaaggcttttgagcgtattttccgccttctgaaagaagaaggctctcaaaaagaggggctttcggatatgcagacgagaaaagaattatatgaaacgatcgcttacgatgactatgaagaactggatcaatccattgccaaaacgatactgccggacgactgaaaaagcccttttttgcaagggctttttttacagcttttttttcctgaaccgcgggctgacttgattgcgtttccgatctctgtacaaaataaacccggccagaacataaaggccgaacaaaaaaaacgccaatccggccgccccctgaagaaaaagggacggaaacggggaaaacgcatgcccgaataatgcatctctcatcagtttaatgccgagcgccgcgacagcgccggggaggaccagaatcaaaagcgcaacaagccggctcatattcagaaaacccctttacgatatgatttcctttattgtccaatcgaaaaaatattttgtcaagagatcaaaacgtggtaacataggggttgtgcaaattattgcaacgggaaatacaggtgtgcaaattttttcatataaaggggtatcgggatgcagaaggtgctgattataggtgctggtaaaggaggcacggcgctcctacagattttgatgaaaacaaaactgatccggattattgcggtggttgatcaagatccggaggcgcaagggctgcaagaagcccggagatatggaattgcaacctcatcagattggaaaccctacataactgaagatatagatattatcatccatacaacaggcgataaagcggtcatggatgagctgctccatgagaaaaaagaacaaaccatcgtcatgccgggaaaattggcgtacatggtgtttcagctgatggaggaaaaacagcagcttatccaaatgctgaagtcgcagacgtataagcatgaccggatttttaattcaacgcacgacggcatgatttttatagacgtcaacgaaacgatcattttatttaatcagatggcagaaaaaatggtcggccgaaaacgggaggatgtcatcggccgccaaattaaagatgtagtgccgaacacaaagctgccgcggattctggaaacgagagagccggaatataaccagaagcagcttctcggcaagcacctgcagattgtcacgacaagactgccgatcattgatgaaggcggaaaacttctcggcgcgttatgcgtgtttaaagacatcaccgacgcagttgaactggcggaagaggtcacgaacttaaaacaaatccgcaccatgcttgaagcgattattcaatcgtcagacgaggccatttccgtcgttgatgaaaacggcatcggaatgttaatcaacaaagcatatacaaaaatgaccgggctgtcagaaagcgaagtcatcggaaaacccgcttccaccgatatctcagaaggggaaagcatgcacctgaaagtattggggacaaggcggcccgtgcggggtgtgaggatgaaggtcggccccaataaaaaggatgtcatcgtaaatgttgcccccgttattgtggatggtattttaaaaggcagcgtcggcgtcatccacgacgtgtcagaaattaaaacgctgactgctgagctgaatcgggcgcgccagatcatccgcacgcttgaagcgaaatacacgtttgatgacattatcggcacgagtgaacaaatgctggttgcccttgaacaggcgaagctcggggcgaaaacgccggcgacgattctgctgcggggagaatccggcacagggaaagaacttttcgcccacgccatccataatgaaagcgaccgaaaatacaataaattcattcgggtcaattgtgcggccctgtctgaatccctgcttgaatccgagcttttcggctatgaggaaggcgcgtttacgggcgcgaggcgcgggggcaaaaaaggactttttgaggaagcgaataacggcagcattttcttagatgaaatcggagagctgacccaaagcacccaggcaaagctgctcagagttctgcaggaaaaagaaattatcagagtcggcggcgcaaaagcgatttctgtcaatgtcagaattatcgcagcgacaaacgtcaacatcgaaaaggccatggcggaaggcgcgttccgcgaagacctgtattaccggattaaccgctatccgatctcaatcccgccgcttcggcagcgcaaagaagatattgaagcgctgagcattcggctcattgaaaaaatcaatcaggattacggccgcaatgtaaaggggctcacgccgaacgcgctgcgagctttatcagcctacagctggccgggaaacgtacgggagcttgaaaatgttctcggacgggcaatgatatttttagagccgcatatggaacggatcgaacagcagcatctgcctgttttcgaatcagagctgaatgacaaaaacggcacccaaagtgattttccggatgtagaaggggaaaagctgtctcaggctgttgaaaaatttgaagcgcacatcattcaaaaaacgcttgaaaagcataaattcaaccgaaccaaaacggcgaaagcgcttggtgtcagcattcggaatctgtactacaaaatggacaagtacggccttgcaaatgacggcatgcaataaattgcagagaaagcgcaaaccgctgcatgttttcttgaaaaaagccggaataaaccctttcgcatatttggcacagaacttgcattgttaaaagcggattcgcacaagaaaggtggtacaaaatgaagctgagagacctagttgaaaaagccgcggcaaaaaacgcaaaaaccattgcagtggcccacgcagcagataaagaagtgatccacgccgtcaaaatggcggcagaacacttgtcggcacgatttttactgacgggtgacagcggaaagctgaaagagcttctggcaaatgagccgaagttcaatgctgacatcatccacgccgattcaccagaagaatctgcggcaaaagcagtgcgcgcagtgcgtgaacaagaggcggacgttttaatgaaagggaatctcccgagctcaactcttctgaaatcggttttaaaccgccaggaagggcttcgttcaaaaagggtgttatcacatgtagccgtttttgaagtgccggactatgaccggctgatgtatgtgactgattcagcgctgaacattgccccgtctcttgaagagctcgggcatattctgcaaaatgcggttcatgtcgcacattcagtagggaaccctatgccgaaagccgcagtccttgcggctattgaaacggttaatccgaaaatggaggcgacgctgaacgcggctgcgatcgtccagatgtgcaatagaggacagattaccggctgcattgcggacggaccgcttgctttggataatgccgtatcccaagcggctgcgctgcaaaaagggatttccggaagcgtagcgggccaggcggatattctcttggttccttcaatcgaggccggaaatatgctttataagtcaatgatttattttgcgaaagcaaatgttgctgctgtcatcgccggtgcaaaagcgccgattgcattaacgagcagagcggataccgcagaaaataaactgtattcaattgcgcttgcgatttgcgcatcacaagaacagtaggaggaacgaacctatggaaatttttaaatatatggagacttatgattacgaacaattggtattctgccaagatgaacaatccggattaaaagcgatcatcgcgattcatgatacgacgctcggccctgcactcggcggaacaagaatgtggacatatgacagtgaggaagcggcgattgaagatgcactgagactcgcaaaaggcatgacttataaaaatgcggctgccggtttaaacttaggcggcgggaaaaccgttattatcggagacccgcgcaaagataaaaatgaagaaatgttccgcgcgttcggccgctacatccaaggcttaaacggaaggtatattacggcggaagacgtcggcaccaccgttgaagatatggacatcattcatgatgaaacagactatgtaaccggaatttctccggcattcggttcatcaggaaatccgtctccggttacggcgtacggcgtctacaaagggatgaaagccgcagcgaaagcggcgtttggcactgattcactggaaggtaaaacaattgccgtgcaaggcgtgggaaatgtggcttacaatctatgccgccaccttcacgaagaaggcgcttctttaatcgtaaccgatatcaataaagaatctgttaaacgtgccgttgaggacttcggcgcccgcgccgttgatcccggcgacatttactcacaggcgtgcgatatttatgccccgtgtgctctcggcgccgtcattaacgatgacacgattaaacagctgaaggcgaaagtcattgcgggggcggccaataaccagctgaaagaaacacgtcacggcgataccattcatgaaatgggaatcgtgtacgctccggattatgtcatcaatgcaggcggcgtcatcaatgtggccgatgagctttacggctacaacgctgagcgtgctttgaaaaaggttgagggcatctatgcaaacattgagcgggtgctcgatatttccgcgcgtgacggcattccgacatacttagcggccgaccgtctggctgaggaacgaattgagcgcatgcgccgttcaagaagccagtttctgcaaaacggccaaagtatattaagcagacgataggaatttgatctggaggtatgaaaatgttcgaacaggaaaaacgcattctcattctgaatccaggctcaacatcaacgaaaatcggtgtctttcacaatgaacgctgtatctttgaaaagacgctgcggcatcccgaagaagagctgaaagcatttaacggcattatcgaccaatacgaatttcgaaaaataagcattcttgagtctttgcacgaacagggcatcaacatttcaaagtttgatgccgtttgtgccaggggcggcctgctcagaccgattgagggcggcacatatgaagtgaatgacgccatgatcactgatttgaaaaacggctacaacggccagcatgcttctaatctgggcggaattattgccagggaaatagcagacggattaaatatccccgcgtatatcgtcgatccggtcgtggtggatgagatgactccgctcgctaaagtatcaggaatgcctgaaatcaagcggaaaagcatttttcatgctttgaaccaaaaagctgttgcccgtcatgcggcggcgtccctcggcaaacggtatgaacagatgaagatgatcgtcactcatatgggcggcggcatcacagtcggggtccatgattgcggacgggtgacggatgtcaacaacgggcttcacggagaagggcccttcagcccggagcgtgcgggaaccgttcctgcgggtgatttggtggagatgtgtttttccggcaagtattcaaaagccgatatgatgaaaaaacttgtcggcacgggcggactctccggctacctggggacaactgacgcggtgaaggtggaaaaacgcattcaggccggagatgagcatgcgaggctcatttatgacgccatggcttatcaagtagcaaaagaaatcggggcggcaagcgccgtattaaaaggaaaagtagacattatcgtcctgacgggcggattggcgtacgggaaaagtttcgtatccgccatcagatcgtacatagattggatttcggatgtactggtgtacccgggagaaaatgaactgcaatctctcgcgcaaggcgcgcttcgggttttagccggcgaggagcagtcaaagcaatatcagatcggcgaaggagtgaaaacaaatggcgactgaatatgatgtggtcattctgggcggcggcacgggcggttatgtagccgccatcagagcggcccagctcggcttaaaaacggccgttgtagaaaaagaaaagctcggcggaacatgcctgcataaaggatgtatcccgagtaaagcgctgttaagaagcgcggaagtgtaccgaaccgcaaaggaagcggcagcattcggcattgaaacggaaggtgtctccctccgctttgacagcgtgcaaaaacgaaagcagggaatcgttgaccggctggccggcggtgtcgcccacttgatgaaaaaggggaagattgatgtattcaacgggtacggacgtatgctcggcccttccatcttctcacctcttcccggtacggtttccgtcgaatacgcaaatggtgaagaaaacgacatgctgataccgaaacaattgattatcgcaaccggttcaaggccgaaaatgctgccgggtttagaagcagacggtacatatattctgacatcagatgaagcgcttgagcttgagcgtctgccccaatccatgttgatcgtcggcggcggtgtcatcggaattgaatgggcatccatgctgaacgatttcggcgtcaatatcactgtgattgaatatgcggaccgcattttgccgactgaagaccatgatatttcaagcgagatggaaaaactgttaacgaaaaaaggaattaagattgtaacgggtgcgaaagtgcttccggatacattggaaaaagcggatggcgtttcaattgccgctgaaaagaatggaaaaaaagaaacgtatcacgccgaacaaatgcttgtttccatcggccgccagccgaacattgaagggatcggtcttgaaaacacggacattgcagcggaaaacggttctatcatagtaaatgaagccggacagacgaaggaatcgcatatttatgcgatcggtgatgtcgtcggcggtctgcagcttgcgcatgtggcctcccgtgaaggcatcattgccgttgagcatatggcgggtcttaatccggctccgcttgatgccgctcttgtgccgaaatgcatttattcaaatccggaagcggcgagtgtcggtctgacagaagaagaagctgcccgaaaaggacatgaacttaagatcggaaagtttccgttcatggcaatcggaaaggctcttgtatacggagaaagcgatggctttgtcaaaatcgtcgccgaccggaatacagatgatattctcggtgttcatatgatcggcccgcacgtcaccgatatgatctctgaagcggggcttgccaaggtgctcgacgcgacgccttgggaaatcggccagtccatacatccgcatccgtcgctttcagaagcgattggggaagctgcgttagccgcagacggaaacgcgattcatttttaaaaggaaagaaggaggggtttgaatgactacaaaccgccatcaagcattagggctttctgacgaagaagccgttgaaatgtatagaaccatgctgttagccagaaaaatcgacgaaagaatgtggctcttaaaccgctcgggcaaaattccgttcgttatttcatgtcaagggcaggaagcggctcaagtaggcgcggcctatgccctaaaccgcgataccgactatgtgcttccgtactacagagatatgggggttgtgcttgcattcggtatgactgctaaggatttgatgatgtcgggttttgcgaaagcggctgatccgaactcaggcggaaggcagatgccgggccacttcgggcaaaaggaaaacagaatcgtaacgggctcatcccctgtgacgacgcaggttccccacgcggtcggaatcgcgcttgcgggacgcatggataaaaaggatatcgtctctttcgttacctttggagaaggttcttccaaccagggagattttcacgaaggggcaaactttgccgccgtgtataaattgccggtcattttcatgtgtgaaaataataagtatgccatttccgttccgtatgacaaacaggtggcgtgcgaaaatatttccgaccgggcggcaggctacggcatgccgggagtcacagttgacggaaacgacctgctggaagtttaccgggccgtgaaagaagcgcgcgaacgggcatctaaaggcgaaggtcctacattaatagaaacggtttcctaccggttgacgccgcattccagtgatgacgacgacagcagctacagagaacgcgaagaagtagaagaagcaaagaaacaggatccgcttcttttatacaaagcatacttgcaagaagccgggcttctaggtgaagaagaagaaaaggccatgctggatgacatcatggctatcgtaaacgaagcgacagacgaagcggagaaagcgccatacgcatctcctgaatcaacgcttgatcacgtttatgcgaagtagggaggaatacttatgtctgtaatgtcttatattgacagtattaatgcagctatgaaagaagaaatggaaagagatccgcgcgtttttgtcctcggggaagacgtcgggagaaaaggcggcgtatttaaagccacggcgggtctctatgaacagttcggagaagagcgggtgatggatacgccgcttgcggaatcagcgattgcgggtgtcggaatcggcgccgcgatgtacggcatgcgcccgattgccgagatgcagtttgccgatttcattctgcctgcggtcaaccaaatcatttcagaagcggccaaaatacgctaccgttcaaacaatgattggagctgtccgatggtcatcagagcgccttacgggggcggcgtgcacggcgcgttgtatcattcccaatctgtggaggccatttttgccaaccagccgggtcttaaaattgtcatgccttcaactccttatgacgcaaaagggctgttgaaagccgcagtccgtgacgaagatcccgtgctgtttttcgaacataagagggcgtaccgcctgattaaaggagaagtccctgctgatgattacgtccttccgatcggaaaggcggatgtaaaacgcgaaggcagcgacattactgtcattacgtacggattatgcgtccatttcgctctgcaggctgccgagcgtcttgaaaaagacggaatttccgcgcacgtattagacttgcgtacggtttatccgttagataaagaggctatcattgaagccgcgtctaaaacgggaaaagtattgctgatcacagaagatacgaaagaaggcggtattatgagcgaggtcgccgccattatttctgaaaactgcttatttgatttagacgcgccgatcaagcggcttgcaggccctgatgttccggcaatgccttatgcgccgacaatggaaaaatacttcatgatgaatcctgacaaagcggaagccgcgatgagagaattagcggagttttaaagacgtaaggaggtttttgacatggcgattgaacaaatggctatgcctcagctcggagagagcgtgacggaagggacgatcagcaaatggctggtatccccggtgatcaagtgaataaatatgaccccatcgcggaggtcatgacggataaagtgaatgcggaggtgccgtcttcttttaccggtacgattacagaacttgtaggagaagaaggccagactcttacagtcggcgagatcatctgcaaaattgaaacggaagaaacggaaaccgaagaggcgccgaagcgggaagaagagcagaataccccttcagacaccgatgcaaaccgtcaaggtaaagaccagtcaaataaagcgcgttattcgccggccgtgctcagattagcgggagaacacggcattcagcttgaagaagttgaaggaacgggcgcaggaggaagaattacgcgaaaagacattcaaaagatcattgattcgggaatgcagcagaagtcggaagcaccggcgccggctgccgttcaaacaacgcaacaagcgccgaaacaacagcaaaaacaagcgccggcgccagttctgtcagccggtgatattgaaattccggttacaggcgtcagaaaagccatcgccgccaatatgcataaaagcaaaacagaaattccgcacgcctggacgatgatggaagtcgacgtcacgaacatgacggcgtacagaaacagcataaaagactcatttaaacaaaaagaaggcttcaatttaacatttttcgctttctttgtaaaagcggcggcgcaggctctcaaagagttcccgcagatgaacagcatgtgggcgggagacaaaatcgtccaaaagaaagacatcaacatctccattgccgttgccacggaagattcgctgtttgttccggttattaagcatgctgatgaaaaaacgattaaaggcatagccagagaaataacggaccttgcgaaaaaagtgagaaacggaaaacttaccgcggaagatatgcagggcggcacatttaccgtcaataacacgggatctttcgggtcagttcaatctatgggcattatcaaccatccgcaggcggcgattcttcaggtagaatctatcgtcaaacgtccggttgtcatgaataacgggatgatcgcagtgcgtgatatggttaatctttgcctgtctttagatcacagagtgctcgacgggctcgtatgcggccgtttcctcggacgcgtcaaagaaatcttagaaaacattgacgaaaatacttcagtctattaaaaaaactccttttgcccgggcggcaaaaggagtttttttattttcattgtgaatcctcgggaacaagcatagtgagatgatgttttttcacttcgatcgtacaaggcgttgttccgtatacctcgccatctgtatccgcgtccatttcacgtccggtttcgatttcaatcctggaggcctgaatataggacagctcccctttgaaatcatcaaacgaaccctgctccatcgtcatcagctcccgcaacgcggcaaggcttgtgttgcggcagattaacacatcggctaagccgtcccggaggctcgcatcaggcaggggaactctgtttgtcccgatataatgcccgttcatgacaagcaccattacggcttcgtcttctttcacctcgccgtcaattgtcaatttgacaggaaacgggttcgcacttgtcatcgtccgcaaggcgctcgtgaagtagctgattttaccaagccatgctttttcagtttcattgatatggctcgatgcttcggtgatcaatccgatgccccagaagttcagaaaatagccgtcatccgttttacagacgtcaatcatccgtttatgtccggccgcgagcgcttcagcggccttttgaaggttttgcgggatgccgagcgcccgtgagaaatcgttgcacgttcctcccggcaaaatgccgacagcgggcctgttatcaagcttgctgatgctgttgatgcattgatgcacagtgccgtctccgcctaaaatatataaatggtcaactgaactgtcgaggttttcacaatactgacgggcatcgtcctgatgtttggtcggtttaatcaaaagttcgtcagctgactgggccaaaatggggacgaccgtgccgagcgttttatcaatctgtttttgaccggcgtttccgttataaattaatactgctttccgttggctcatacgactgctcctttatttcagacaatctctttaacaagtttcccgtttttaaaaggtcataaacttacatcaggtacataaaaggaacaaaaaacaatttggatatgagcggtgtcatttgccgatagtgaggttccttgctatcataagaaaagatgatcaaaaaggagaggtcccagttgaatatggattttaatttatttatgaatgatgtcgtgcgtcaagcccgccaggaaatcacggccgccgggtatacagagctgaaaaccgctgaggaagtggacgaagcgctttcgaaaaaaggaaccacactcgtcatggtcaactctgtgtgcggatgcgcaggcggtattgcacggcctgccgcataccattctgtacattacgataaacgcccggatcagcttgtgacggtatttgccggacaggataaagaagcgacagccaaagcgagagaatactttgaaggctatccgccgtcctctccgtcatttgccattttaaaagacgggaaaatcatgaaaatggtggaacgccatgaaattgaaggccatgagccgatggccgtcgtcacaaaactgcaggaagcatttgaagaatattgtgaagaagtataagtgaaagaaaaaccccggagccgagcgcttccggggttttttatatggaatctgtataaatataaatatttatacaccggcgttcagctgtcactaatcggaaaaacaatgactataataaacagagaaaggaaaatatatttttcaaaaatagtattgcatcacaattaaaaagtgtttaaaatacaagttaacgaataaatattcaattttaagagatcagtagatatgggggaaatgaatcatgaagaaatggctgttggtattagctgccgcatgtatcacctttgcgctgtccgcctgcggatcaggcaattcaggctcagagggcggaaagaataagctgattatgggtacatcggctgactataaaccatttgaatataaagacggcgatcagatcaccgggtttgacgttgatctggcaaaagctctgggcaaaaagaccggctatgacgttgaggtgcaggacatggacttcaacagcctgattacagccttgaagtccaagcaggtagatatgattttatctggaatgacacctacgccggaacggaaaaagcaagttgatttttctgatatttattatactgctaacaatatgattgttacgaaaaagggaagcagcattaaatccctgaatgatctgaaaggcaaaaccgtcggtgttcagctcggctccattcaagaggaaaaaggcaagaagctcgcttcgaaatacggttttcagctcgaagaccgcaaccggatctcagacttaacggaagagattaaatccgggcgttttgatgccgcgattatcgaagacatcgtagcacaaggctatttcagttcaaataacgatctgcagggctttgcgtcagcagatgcgaaatcagacgaatcgggctccgcgattgcgttccgcaaagacagtgatctgacagcgaagtttaacaaagcgctgaaagaaatggagaaaaacggagaaatcgaaaaactgaagaaaaaatggttcaccaacgagaaataaaaggaagctcaacttttcgttgagctttttatcttgaataaagacaaaggagatcacacgtatgaatttggatttctcagcgacaatcccccaaattccttttatattggaaggccttgcggtcacattaaaaattgtgctcgtttcagcggtcatcggtcttgtattaggaatcgtgctcagcttatttaaaatcagcacgatcagtccgctgaaatggattgcggatttttatacttcgatattccgcggcacgccgcttgtgctgcagctgatgatcatctatttcggtatgccgcagcttctcggctttcagatcgatcaattttgggcggcggtcaccgcattatcgctcaattcagccgcttacgtctctgaaattatcagagcgggaatcaacgcaattgacaaaggacaaaaagaggctgccgtcgctctcggcgtgccgtacggaaaaatgatgaaagatctgctgctgccgcaggcgtttaaaaacatttctccggctattattaacgaattaatcaccttgacgaaagaatcggcaatcgtcacggtaatcggtctcggcgatattatgagacgggcctaccagtccggcgccgcaacatacaactatttagaacctcttattgtggcgggcttaatctattacgtgctcgttttgatcttagcattcatcggaaaaggcgtagaaaggaagctgaaagccaatgattaaggtcgacaacctgtcaaaatcattcgggaaacatgaagtactgaaaaacatttcaacacagatcgaagaaggggaagtcgtcgccgtcatcggcccttccggttccggcaaatcaacgtttctgcgctgcttaaatctgctggaaaccccgagcggcggaacgattgccattaaagaaaacgaaatcaccgcagctaaaacgaataaactgaaagtgcgggaaaatatcggcatggtatttcagcattttcatctgtttcctcataaaacggtgcttgaaaatatcacatacgcgccggtcagcgtgaagaaagagtctaaaaaggatgcggaggaaaaggcgtgcgctctccttgaaaaagtcgggctgcttgacaaacggaacgactatccgaaccgtttgtcaggcggacagaagcagcgggtcgccatcgcgcgggcgcttgccatgaatcctgacatcatgctgtttgatgaaccgacctcggctcttgacccggaaatggtcaaagaagttcttgaggtgatgaaagagctcgcgcagacgggcatgacaatggtgatcgtaacgcacgaaatgggatttgccaaagaagtcgcagaccgcgtattatttatggatgaagggacgatcgtggaagacggtcagccggaagaattttttctttctccgaagtcaaaaagagcacaggactttttagaaaaaatattataaaatataactgtaagaaaagaagaagaatgctcttcttcttttttttgagaaagaaacaaacagaatggagcaagcaatgtttaaaatcggttaccggacactaaagaccgcacttggaacggcgctggccatttatttagcccagctgttgcatctgcaaaacttcgcatccgcaggaatcatcaccatattgtgcatccagattacacaaaagcggtcgcttcaggcctcgtgggcccgatttgccgcctgtttattggcgatcgtcttttcatatgtctttttcggactgatcggctattatccgtttgcgatcggaatattgctggtgctgttcattccgactacagtcgttttaaaaataaatgaagggatcgtcaccagctcagtaatcattcttcatttatatatgtccggcggcattacgatggcgtttatctggaatgagttccagctgatcaccgtaggtatcggcgtcgcgctgttaatgaatctgtatatgccgagcctcgacagaaaactcgcagcgtacaggaaaaaaatcgaggacaacttttccgtcatcttcgccgaaatcgaacggtatttgttaactggtgagcaagattggacagggaaggaaataccggagacgcatcagatgattcaagaggcgaaaaacctcgcctatcgggacgtgcagaatcatattttgcgccatgaaaatctctactatcattattttaagatgaggcagaaacaatttgaaatcattgaacggctgctgccgaagattacctctatttcaataacggtggagcagggaaaaataatcgcccatttcatccatgaattaagggaagccattcatcccggcaataccgctcataaatttttaaaaagacttgcagaaatgagaacggaatttgaagaaatgccgctcccggcaacgcgtgaggagtttgaagcgcgggcggctttgttccacctcctcggtgagatggaacaatatctcgtgattaaaagttatttcaaaggcatcaagctgtaaaaaacatatggatcaatcgcatgagtcctcctttcattggtcattctaatgaaaaaaggaggggagcccatgcgattttttttattgtcagccgtcctgctgctgtctccgctttggccgcttggcgcgaaccctttgccgggtgacccttatattatcgtcaataaagccacaaatgcgcttgctgttgtaaaggataaccgaatagaaggcatttatcaggtggcgacgggaaaaacggatgatttgacgcctgaaggagaatttacggtaacggtcaaagccgtcaatccgtattaccggaagaaaaatgtagagggaggcgcgccggaaaacccgctcggcgtccgctggatcggttttgatgcgaaaggcaccgacggcagaatatacggcattcacggaacaaacagagaagagctgatcggggggtttgtatcaaacggctgcatccgtatgaaaaaccgggatgtcatccgtattttccggattatccctcccggaacgaaagtattgattacaaaagaaaaccgctcattcgaggacattgcaatagagcggaaagccctcataaaaaagcaggaaacccccttgcaatgaggcgcctgcttttttactgcaaatacatcataatgcctgagaggagggttgaaagtataaatacgcccaaaatgacgatgacggcgcttttcataaatttttgagacattgtttcactccttaagattactgtctaccattttaacgtgttttgcttatatgaacaagccatatcctatgggggaaagcaggtggccgcgctatgaaaaaacttgatcatgtcggcattgccgtcagctctattgaagccgcgagaggattttacgaacggatgctcgggcttacgtatatgggagacgagctggtaaacggccaaaatgtgagagttgcttttttagaagcgggaggcacaaagcttgagctgattgagccgctgtcggacgcgtctcccgtcagctcttttttacagaaaagaggcgaagggctgcatcatttggcattccgctgcgccgatatgaaggaaacgatcaaggagcttgaatcatgccgcatgaccttgcttcatcatgaaccgcaaaacggagcgggcgggaagaagatcgcatttctctctccaaaagaggcgaacggcgtcctgattgagctttgtgaaacaattgaaaaaggagaaactcaagatgaacatgagtgatcatatcagacacttaaacgaaagacgttcctttttaacaaacggcggcggagcggaaaaaaataaaaaacagcacaaaaaaggcaagctgacggcaagagaaagaattgactatctattggacgaagacagtttttcagagctgcagccgtttgccaaaagccgcacgcccgggtgccagaatgctccgggagacggcgttgttaccggatacggcacaattgacggacggcccgtgtatttgtttgcccatgactttaccgtactcggcgggacgctcggcgagacgcatgcggaaaaaatcgcggcggtaatggatctggcggcgaaaaacaaaaacccgatcatcgggctgaacgactcaggtggtgcgagaattcaagagggtgtggtatcattaaatggatacggtcatatctttaggcgcaacgtcctttactcgggagtgattccgcaaatttctgtcattcttgggccgtgtgccggcggtgctgtttattcacccgctttgacggattttgtgattatggcggaacatacgtcgcacatgtttattacaggtccgaaagtcattgaacaggtgacgggtgaacagattgacgcggaaagtttaggcggtgcgggaatacataatgtgataagcggaaatgcccactattccgcacgaacggaaaaagaggcactttcggctgtgaaaaccctgctttcttatctcccgcacggcggacagacggcactacccgttaaaaaggaagacgccagaccgttattaaacaccctcgttcccgcggacagttcgaaaccttacgatgtgttacaggtaataaaagagctggcggatgacggaacgttttttgacattcagccgtattttgccaaaaacattgctgtcggttttctgaaactcggacggcgtacagtcggtgttgtcgcaaaccagccgaaacacttggcggggagcctcacgattgatgccgctgacaaagcgtcgagattcatccgtttttgcgacgcgtttcatattccgctattgacgatcgctgatgttccgggatttcttccgggccttcagcaggaacatgcgggaatcatccgtcacggagcaaaattgctgtatgcttttgccgaagcggcggtgccgaaagtgacgctcatcatcagaaaagcttacggaggcgcttatgtcgccatgaattcgaaagggctcggagcagatcttgtattcgcctggcccaatgcggaaatcgccgtgatgggagcggaaggcgcggcgtcgattttatacagcagagacatacaggcttctggggacccggagaaaacgaagcgcgaaaaaaaagccatatacgaaaaggaaaacgccggtccgtataaagcggctgcctgcggtatggtggatgatatcatccggccggaagactcgaggaaaaaattgattcaggcatttgacatgcttgcgcataaggaagaggaaagaccgaaaaaaaagcacggtaatataccgctttaaacggagggaactgaaaatggtaaacgaaaaacgtctgcttgaagaatttcttgaactcgttcaaattgattcagagacaaaacatgaagcggaaatcagcaaggtgctcaaacaaaaattcactgatttaggattgagcgtaaaagaagatgatacaaaagaagtgacggggcatggagccggcaacttaatctgtacgttaaagggcacaaaagatgcggatacgatttattttacatcccacatggacacggttgttccgggcaaaggcgttaagccgattgtggaagacggctatgtaaaatccgacggcacgacgattctcggcgctgatgataagacgggccttgccgcaatgtttgaagccattaaagtgctgaaagaacaaaacatcgagcacggcaccattgaattcattatcacggccggagaagaatcgggattagtcggggcaaaagcaatggatcgttcagacattaccgcgaaatacggttttgcgcttgattcagacggaaaagtcggcaacattattgtagccgcgccgacacaagcgaaagtgagagcaaccattttcgggaaaacggctcatgcgggtgtagaaccggaaaaaggcatctccgcgattacaatcgcatcaaaagcaatctctaaaatgccgctcggccgtattgataaagaaacaacggctaatatcggccgtttcgaaggcggcacgcaaaccaatatcgtctgcgaccaggttgatattctggctgaagcgcgttcattagtgcctgaaaaaatggaagcgcaagtgcagaaaatgaaagaagctttcgaatctgctgcagctgagatgggaggccgcgcggaagtggacatcgcggtcatgtatccgggtttcaaatatcaggacggcgatcaggttgtggaagtcgcgaaaaaagcggcggcaaaaatcggccgtccgagcgaacttcagacaagcggcggcggaagtgacgcaaacgtcattgccggccacggcattccgacagtcaacctgtcagtaggctatgaacaaatccatacgaaaaatgaaaaaatgccgattgaagagctcgtcaaaacggcagaaatggtcgttgccattatcgaaacagcggccaactaaaaacgaagcacccagttgattgggtgcttttttcattcttcatgatattaggcttaaagctttgcagatacaagaaaaaaccctgccggataggttccggcagggtttcagtattatgatttggcgggctccgcctgagccgcagcctgtttctttttatgatgcgtctgctgtaaaagtacgttctgcactgtcaaaaacagtccgcttgtaaaccagtaaagcggcagcgcagccggtacgttaagcgaaaaaacggtcatcatgacagggaaaataaagaccatgatttttgctgactgcatcgcggccggattttgagcagccggtgaatatttctcgtttaatttttgggaaatataagcctgtaagaaatacatggccccgcgcacagtgatacaagaatatcagaatgccctaagctgaaccacagaaatgagtgtgaagcaatttccggcgttgagcggatggcgtaataaaaaccgatcaaaatcgggaattgcaccagcatcggaagacatcccattgccatcggattcagattgtgctcacggtaaagcttcatcatttccatttgcagttctttttgtttttccgcatctttcgtttgtttcattttagcctgaatgctgtcgacctgcggtttgatcacagccattttttcctggaacacccgctgtttcttaaattggttcacaaacaaaggcaatacaacgatccggacgataatcgtcaccagaataatcgacagtccgtactcaccgtggaacaggcccgccaccccttttaaaagtgccgaaaacggctcgatcaggtaatcgtggaaaaaaccgatattcccgaggcctcccgtctgagtctgagatgtcgccgcaaaagccgagcggcctgtgcacagtacgataaaaaataatcccaatacgatccacttttgatatgttttagacaattatgtttcctcctttatatcttcacttgccgttataaaaggaggaagctgacatcttcatcatcattcgccggtgaattcatgcggatgactttacgtatccaagttgtaatgcgatgatatataataataagaaagtctgttcggttcagctgaacgactgcttgatgttcatctattcgtttcgttctccaatgctcgcctgcgcggcgctcacgcaaaagaaaagcgatgccgatcgcggtcagagcgggaagaataattgtgaaaaaatcgactaaaaataaaaagtcattcattgactcaagaatcattttatcacatccattcagctcttattttactacatatatataaggttgtctatgaaaggaaaggaggcgccgggagtggccggaaaagggagaattatatttcatatcgatatgaacagtttttatgcctccgtagaaatggcgtatgatccgtctttaagaggaaaacctatcgccgttgccggaaacgtgaaggaacggaaaggaatcatcgtcacctgcagctacgaagcgagagcgcggggcgtaaagaccaccatgccggtgtggcgggcaaaacgcctctgtccggaactcatcgtcgtgcctccgaattttgaccgctatcggagttcgtcaaaagaaatgttcagcattctgagggagtatacggatttagtcgagcctgtttctattgatgaaggatacatggatattacggacacaccgcacagacacagggcgtatgagacagccgcagacattcaggcgagactgcaaaaagagcttttgctcccgtcaagcatcggcatcgccccgaataaatttctcgctaaaatggcgtctgacatgaaaaaaccgctcggcatcaccattttaagaaaaagagagctgccggacgtcttatggcctcttccgatagaagagatgcacggtataggaacgaaaactgcggaaaaaataaaaacgctcggcatcaaaacgatcggtgatttggcaaaaggagatgaacatgcgctgaaaacgcttctcggcataaacggcccgaggctgaaggataaagcgaacggcatccatcctgcagaagtcaatcccgagcggatttatgaatttaaaagcgtcggcaactcatccaccctgtcgcatgattcggctgactgggatgaattaacgggcgtgtttgaccggcttgcgctgtctgtgagcgaacggctccagcgtaaggaggtcatggcctgccggctgttcatcatgattcggtatgcggattggaaaacggtcacaagaagcatgaccctcagcaatccggctgatcagaaaaaagacatcatggaagcggcgatggaactgtttgacaagcactggaaccaaaacccggtaaggcttctcggcatcaccgggacggaactggttgaaaaacagcaggcgtataaacagcttgatctgttttcattcaaggaggacgcaaaggatgagccgatttttcagatgatgaacgagctgaatgaaaagtacggccaaaacctgatcagaaaaggcgccgttataaaaaaagaagaaagcaaaacaaggggcacgagctttaacagagacttttttcaggatgaaaagaaaaggtgaataacttgaaaaaaggggttatgtatgataatttctttagtataaatatcattttattttaatttaaattttaaaatggttaaacgtttgaagaagggacgttagaatatgtcaaaacaacaaatcggagttatcggtcttgcggtaatgggtaaaaatctggctcttaacatcgaaagccggggattttctgtgtctgtatacaacagatcaagcagcaaaacggaagagtttttagaagaggcaaaaggtaaaaatgttgtcggtacatacagcattgaggagtttgtccagtctcttgaaacaccccgtaaaattttattaatggttaaagcgggaactgcaacggatgcgacgattcaatctcttcttcctcatctggaaaaagacgatattttgattgacggcggaaatacatactataaagatacacagcgccggaacaaagagcttgccgaaagcggcattcactttatcggaacgggtgtatcaggcggtgaagagggagcgctgaaagggccttctattatgccgggcggccaaaaggaagcgcacgaactcgtaaaaccgattttagaagccatttctgctaaagtggacggggaagcttgtacgacatacatcggcccggacggagcgggacactatgtgaaaatggtgcacaacggtatcgaatacggtgatatgcagctgatctctgagtcatatttcattttgaaacaggtgctcggattgtctgccgaagagcttcacgaagtattcgctgagtggaacaaaggagagcttgacagctatctgatcgaaatcacggctgatattttcactaaaaaagatgaagaaacgggcaaaccgctagttgacgtcatccttgataaagcaggccaaaaaggaacgggtaaatggacaagccaaagcgctcttgacttaggcgtgccgcttccgattatcactgaatctgtttttgcgcgtttcatttccgcaatgaaagaagagcgtgtgaaagcaagcggccttctgtccggaccagacgttaagccggtcactgaaaataaagaagagctgattgaagcggtcagaaaagcgctcttcatgagtaaaatctgttcttacgcacaaggcttcgctcaaatgaaagccgcgtctgaagaatataactgggatctgaaatacggtgaaatcgcgatgatcttccgcggcggctgtatcatccgcgcggcgttcctgcaaaagatcaaagacgcatatgaccgtgaaccggagcttgacaacctgctgttagacagctacttcaaaaacattgcagaaagctaccaaggcgctcttcgccaagtgatttcacttgccgtagcccaaggcgtgccggtaccttcgttctcaagcgcacttgcgtattacgacagctaccgtacggcagtgcttcctgcaaacttgattcaagcgcagcgtgattacttcggcgcgcatacgtatgaacgcacagataaagaaggcattttccatactgaatggatgaagtaatgaagaagcccccgcattgattgcgggggcttttctgatattaaaaaccgcgggccgtcatgaacggcgccgcggtttttaaattttttcttatatattccaccagtggagaccgtctttttcaagaagatcgtccgaagctttcggtcccattgaccctgcttcataattcggagaaagggttttgtcggctgcccacgtttcggaaatcgcatcgacgaaattccaggaaagcgccacttcgtcccaatgggcaaagtttgtcgcatcaccgagcagacagtcatggattaatttttcataggcttccggtgtgttcatttcatcactgcagttgctgcagtagtccagcttaatcggctgagcatgagcggctccgcctaattttttagcgttcagatatagtgtgatgccttcatccggctgaatatggatgacaagcaggttcggatttacattcgtttcattgccgtaataaaggttcatcggaatgtctttaaattgaacgacgattttcgttgatttttctttcatccgtttccctgttcggatataaaacggaacgccggcccagcggaagttatcgattaacagctttccggacacgaatgtttccgtattggaatccggtgctacattatgctcatctgtatagcttggtacagagtttccgtcaatcgttcccgcttggtattgtccgcggacgaagtagtcactcacttcgtttggagcgacagggcggagagctctcagcaccttcactttttcgctgcggatttcttccgtgttcagtttaatcggcggttccatcgccaagagagcgaccatttgcaaaatatggttttggaccatatcacggagtgcgcctgatttttcataatatctcgcgcggtcttcaacgccgagatcctcgcttgacgtaatctggatgtttgagatgtagcggttattccacagcggctcaaacagcgcattcgcaaaccggatgacttcgatattttgaaccatttgtttgcctaaataatggtcgatccggtaaatttgatcttccgtgaaagcttcgcgtatttctttgttaagctctttcgcactcggcaggtcatggccgaacggtttttcaatgacgagacgggaccagccatttgtcgctgtgacaccttcgtttttaagtgattttgcgatcgtgccgaaaaactcaggagccatcgccaagtaaaacattctgttgttcgggatttcatatgtatgttcaagctgatcaagcaggacattcagctcctgataggaacccggattcgttacatcaaacggatggtaataaaaatgagatgtgaaatcgtctatgtctttttgcccggcagaagaaacagacgttttaaccgtttcccggaggtcctcgtttgaccaaggtcttcttccaacacctacaactgcaaactcttcaccaatttgaccatttttatataaacggtgaatggatgggtaaagttttcgttttgccaaatcccctgtggcaccaaatattacaattactgcttttggtttgtcgtttgttttcacttagagtacctcactttatctgaagcatggtttaaaaccccgcatatttccttcattttaaatctaaaattcattgaaagcaaacatttcagcctgttttttgcggtttgcggaaaaaaattaatcaggccggagaaggcccgggtgaattcacattttcagtctgatcctgtatccttagtagtacaaagatctaggaggaagcattgtggaattattatttttagggacgggggccggcatgccggcaaagacgagaaacgtaacgtccgtcgcgctgaagcttcttgaagaaaggcgttccgtatggctgtttgattgcggagaagccactcagcatcagatattacatacaacaatcaaaccgaggaaaatagaaaagattttcatcacccaccttcacggcgaccatgtttacggtcttccgggtctgttggggagccgttcatttcagggcggtgaagaagagctgacgatttacgggccaaaaggcattaaagcctttatcgaaacaagcctgaacgtgacggcgactcatctgacgtatcctcttaccgtacatgaaatcgaagaggggacggtttttgaagatgagcacttcattgttaccgcagcatccgtcattcacggtgtggaagcgttcggctaccgggttcaggaaaaggatattcccggcgcattgcaggccggcagattgaaagaaatgaatatcccgcccggacccgtctatcagaaactcaaaaaaggcgaaacggtcacacttgacgatggcagaatcattaatgggcgggattttctggaatccccgaaaaaagggagaatcgtcgctttttccggggatacgagggcatcagagcgggtaacggagcttgcgcgcaatgcggatgtgcttgttcatgaagcgacgtttgccaaggaagatgcaaagctcgcacataattattatcacgcgacgacagaacaggctgcgcaaacggcaaaaaaagcaggcgccaaacagctgatcttaactcatatcagcgcaaggtatcagggtgaatcgccgatagagcgtctcgaacatgaggcgaaagcggtatttgaaaacagtaagatcgcatttgacttcatggaggtcactgtggagcggtcttaaaaaatagacgcttgacatttttttctgatgatatataataaaacgtaataattacgatttaaaaaaggggtgaaaatgatgcgtgtgaatgttacattggcctgtacagagacaggggacagaaattatatcacgacgaagaacaaacggacgaatccggaccggttagaaatgaaaaagtattcaccccggttgaaaaagtatactttgcatcgtgagaccaaatagatcacgataacaaaagccattgtgccgttgcacaatggcttttgttttcatcagtttaccgcctgataggcaggagcattcatttgctggcgcaccgcgcaccaaacatcataaatggcaaggtggacgatgtgcggttcatcgtgatgaatggcatgagaactgtttttggcctgaatccatccgctttgataagagacatcaagcatgcttctgtgcagtttcacccattgttcatgagcgtgctttaagcgctcatcccgctctcccgatgataaaatcaacagcggcatatcgccgaaatgaatctgctgatgctggatctgcctaaggctcgttaaaaattctgcgtgtgatccttccaatttgaactgtttcaaataggcggccttcatttcttcaggaagaagcggaagcactttcgtctcctgatcctcagaaaccggatcaagcagcaccatcccgagaatatcccggcggttccggctcgcccaaagtctgctgataatcgtgccgtatgaatgcgagacgacaaggtaaggaggcttgacgccggccttcagaagaagagcgcttaattcctgtaccatatggtccgccgttctcttgtttcggcttcgtccgcttttgccgattccggctctgtcatatgtgaaaaccccaaattcttcatctatgtcagcgagtaatgatgtccatgtttcagaagaagtgccgtagccggcttcaaagacgatcgtcacttcgccggcgcctttacggtgtttcgtataaaacggacacccgtcaatcagatatgtcctttccatccatgctgctttcattggagtcatctcctctaattggttctatagggaagacggagaagcttcggcaatcgtttctcgaaaaataaaaaaagagacagccgggatcgaaaaactccggctgtcacttcatcaccatgctctgtcgtattggaccggtgacggtatttcagtattcagctgcttcgctgcactccttgcaaagtgcggatcgcggagaagttctctcgcgacaaaaataaggtcagcgcggttgttgtgcagaatttcttcggccattgttcccgtcgttatcaaaccgacggcgcctgttgcaatttcggcctgttcacggattttctccgcgaagctcacttggtagccggggaagacgttaatatcagcttgaacgagtgcgcctgagctgcaatcaatgaggtcgactccctgttctttcatccacttcgcaaaaccgatatgatccgcaatgtccagccctttgtctgtataatccgatgcagaaatacggacaaataacgggccgtcccagacttccttgacggcttcaatggtctcgcctaagaagcggtagcgattttcatgtgagcctccgtattcgtctgtacggtgattggacagaggggacaaaaattcgtgcattaagtagccgtgtgcggcatgaagttcaatgatgtcaaagccggcttctttcgcgcgcgccgctgcctgtttgaattcctgaatggtttctttaatttgttctgtcgtcatttcagccggtgttttggactgctcatcgaacggaatggctgacggagcgtaaatgtctccctcaagctcagctttacgtccggcgtgcgcaagctgaatgccgattttagatccttgcgctttcacttgttccgtcagtttggcaaaaccttcgatatgatcatcgctccagatgcccaaatcctgatcggaaatgcgcccctgaggattaacggctgtcgcttccacgataatcaggccgacctgtccgattgcacgcgatatgtagtgcgccatatgaaaaggctgcagttttccgtccttctcatgtgaggaatacatacacatcggtgccataacaatacggtttttgatcgttacatctttaacggtccatggtgtgaataattttctcgccatttatttcgcctcccggaatgtttttcgacattgattataacaactcatgatcattcagtcatataaactgctcacaactgaacagatcgttcttattgttctggacgggcatttttttatacacagcgtggccgtatcttcataacaggcatttacagccgatcatatagcaaatatagatgagaaacgcaccgatgactgcgtggcctcctttgatccagtttgtcaggatgaaaatactgctgatgaagatcactgcgccgaaggcaccgaatattccgtttttttgagcggctctgaaatcgtcggggctcatatttttcagctgcaagtgaatattcagtaacgacatgatcggcagcaatgtgataacgcctgataaaaataagtatttcgacttgcttaaatacgcggcggccaccataacggtgccgccgataaaaaattgaatgagaaaactcatgctgaaacgctcaccttctgtttgttatcaagtataatgatggagacattgccattttatttttgattgatgtataagtaaactaaatataactaatgcattggataataaagaatgatatctgggagatgaagccgattggatttaaagaagcatttagcctttattaaaacggtagaaagcggcagcctgacccaagccgctgccatattgaattacacacagccgaacatcagccaaatgatcagtaaattagaggaagagtacggttttccgcttttgatcagacagcggcatggagtgaggcccaccgcaaatggcttgaaagtgttacatattatgaaggaaattcaaaaaaactatgaaaaactgtctcaaaccgttgataatattaatgggttagaaagaggggaagtccggctcggcactgttacgagcgtggcggtaaaatggctgccgaaaattttgagggaatttaatgagctgtatccttctattaaggtgcatttatttgatggaaattctactgagctggaacaatggctgaaagatgaccggattgatgcggcgattgggacatcccacagcgagaagtggcatttttacccgttggccgaggacccgattgtagcggtgatgagcccgcagcatgaattggcgcaatatgaaacggttccgttacatgtcatggagtccgtcaaatgtatcgtgccttatccggagacacattttgatgtgctgaaagtgttaaaggaagaaaagatcactccgcgggttgcttatcaaatcagaggggatgaagcgattattgcaatggtgcggaataatctggggatcagcatcttgccgcagcttttggtgaatgatggtgatgtgctcatcaaacggttcgaccggtatgtctccaggcagctcggcattttgacagctcgtgcaaaggagacgcagacaccttctgtccagaaactgattcaatgcatacaagaatgggttgcggtccatcaggcttctgcctgaagaagcctgatatgcgtttaagccggttcaggataatagaccagcaataaatatgtcatcggttccgaggaatgaaaataactgtgcggcatcgcccgaagtcagcacatgcttttcgtcatgaagctcaaccgtcaattcaccgctcttgattaaaatgattcccctaaatgtgattttgtctcataggcgcagcccggcttcaggtcaactatgccttgaaaacaaaaatttgaccgtgacggtggtgagcggggttattttgatgtcgggctttcgtctgtttatataaaaagggcatcaacggcacatgctgttgatgctttttttgaaatgctagggtttggagagcacttcaattccgacgttgaccattttgtccagccccataaaagacaggcagattttggcgcgtctttttcttttatcgatttttttaataatgccttccattcctttaagaggccctgaggcaacggttacttttgaattttcaatatagacttttgaataatctacagtgtctccttctccgatcagcctgataatagggaggatttcttcatccttaattgtcgtgaaataggttttgcgctctttggaataatatgctccgttattcacgattctgcatgaaatggggagttctttgattttatgaaatgtccgctctgtcatctttgttttaaacagaacatatcccggaaacatctttttgagtgcctcgtatttaattccggcttttcgttctgtgacttttttcttgggtatgattgagtagagagcctgctcatcaaactgcagacgcagaaatttttgaactgcttcttcttttcccgactctacaaaaagtgcgtaccatttcatgactggatcctccttagaataataagaaattattatacaaagaaagtatttaatggatagtatttaaagtgattaaaaatttttctaattcgtcttttttttacataatatatgaaaatgaaaaataagtatagacccaattgacagagaggcgatgaattttctttgacatgaaaagggttcagggaattatctgacatttatcccgaaacaattatgccgactgtccaccgaatataaaactgtggaataaatgtcagaaaataacgaaataaagccttgacattattatctataaattgatattattctctttaaatagcaactatttgttaaatttattaaattaaagtaaagcacctattaaatttcaatcgctgtttcggcacgttgaagaggaaatagggattataaaaatgattgcagtgtatatatctacatatacatgataagggagaagtgtgccgtcatggctgttttcgggcatattggcactgcagcttgtcatgcgaaacattcagtaaacaagcaagatgttttaatataaattatgttagaaaaggaaaacacaatgcgtttgcgatttttaaacctgtgctgaatcgcaaacgcgtttgtgtttttatttttatggcggtgtttacaccagtcaatatatgaaataagagacgtttttgtatggagaaccacatgtgatgtacaaaattggcgatggggaaaggatgaggataagatgcttacgtttgtgttcccggggcagggttctcaatttaaaggaatgggagccgggctgtttgatgaatttcaagatctgacacgtcaggctgatgacatattaggctactctatagaagaattgtgcctggaggatccgaatcatcagctggggaaaacgcaatttacccagccggcgttatatacggtaagtgcactcagttatttaaagaagattaaagagtccggcagagagcccgattacgccgcagggcacagtttaggagaatataatgcgttatttgcggccggctgctttgattttaagaccggtttgcagcttgtgaaaaaaagaggggagctcatgagcaaggcagctcccggaggcatggcggcggttttggggtttacggctgaacaagtaaaagaggttctatccgattatcatctgaccggcattgatatcgctaaccacaattcaccttcgcaaattgtgatcgccggaacgaaacaagacattcaaaaagcgggccccgcctttgaaaaagccggcgtgagaatgtatcttcctttaaatgtgagcggcgccttccattcccgctatatgaaagatgctgaaaaagagttcgcggattatttagaagaaacggcgtttttgcctcttcgttttccggtgatctcaaatcttcatgccgcaccttataagaatgatgaaatcaaaacaaatctgactttgcaaatgaccaatcaggtaaagtggacggacacgatacgccgtctgataggacttgaaaataatgaaattgcagaagtcgggcccggggaagtgctgacaaaactgacgaggcagattaaaaaagatgccgtcccattacctatgccgaaagaagagtctgatactgctgatgttaaagcatcggcagctgattcccaaaaaacggcgggaatgagattagggaacgaagattttaaaaaagattataacatccaatatgcttacatgacgggctccatgtacaggggaattgcttcggaacagatggtcattaaagcggcaaaagcgggaatgctgggctttttcggaacgggcggattgagtatcgaacggatcggacaggccatcggaaccatccggtctgcactgcggcaaggggaaacattcggaatgaatcttcttcatcatatgatgtcacctgacaaggaagtcagaatgatagatttatatttaaaaaacggcattcaccttattgaagcatcggcatttatgggcataaccccggctctcgtgatatacagggcaaagggattaagcaggaatcatgacggatcggtgtcagtccaaaacagaatcatcgcgaaagtatcccggcctgaagtcgctgaggcctttctgaatccggctccggctcatgtgctggaaagacttgtgtctgacaatcggctgacagccggggaagcggcgcttgcaaaagaaattccgatggctgatgacatttgcgttgaagcggattcaggagggcataccgaccaagggattccgtatacattaatgcctgccatgatcagactcagagaccgcatgatggagaagcacggttatgcgaaaaaagtaagaatcggcgcagcgggcggcatcggcactccggaagcggctgctgccgcgtttctgctcggcgccgaatttatcggaaccggttctattaatcaatgcacggtcgaagccgggacaagtgattcagtgaaagatctgcttcaggaagcgaacgtgcaggatacgtcatacgctcccgcgggagatatgtttgaagcgggagcaagggtgcaggtgctgaaaaaaggcctgtttttcccggcaagagccaataaactctttgacttgtacagacaatacaattctttagatgaaatagatgaaaaaacgaaaacattaattgaagataagtatttccagcgcagttttgaggaagtgtatgagcagttgaaacgtgataaatctcctgaacagatcgccaaagccgaacagaatccgaaacacaaaatggcgatggtatttaaatggtatttttcccatacgacgaggctcgctctggaaggaaaaagcgaaagtaaaatagattaccaaattcattgcggccctgcgctcggcgcgtttaatcaatgggtgaaaggaacccctcttgaaaattggagaaacaggcatgtcgacttgatcggcaaacagctcatggaagaaacagccggccttcttgcgcaaaggctggtatcgattacaggctgagtatgaccagacattacattttttctgcggaggactaccatgctgattgaaaatcatgaattaacgatgagccatgtcggattagggaatttgaatgagtacgcgctgctgctgttattcggcaatgcacacagtcaccatttaacggacggaacgggattccggcctgatcagatggccgatcaccaagggctgattttgtatccggcttattttatgacacatctcaaagttccttcagataagcctcttgatcagtaccgattatgggacgaggtttccgtcggagtcgatatctcccggtttggagaaaccatattagaatctgattatttgttcgggccgaaaggagcggtcagctctgataaaagcgagtgggaccggggacggtttccttctatgaaagccaatagtttaattgtcgttgacgtcacacaaacagaaggttcgacgcgcaaagtctcagcgccgaaggctgaatgtattgcggaactttctaagctagccaagccgccttacgcgctgatgcggtcaaagaaagtcagaacggacgctttcggtatgaagccgggaaacctcaaaacagcggaccccgtttcatatcgggttcctgttgatcaggatgctgcgccggggcatgccatggtgtttgcgaaattcagcaagataatggatgcggcggaatttgaatggatgacgcgccggtcgaagccgggttttccggtttcaatcgcgcggcatttatttttgcttgaaagagagacgtattattacggaaattgttttgcagatgaagagcttgatatttatatgacgggacacattgaagaatgcgatcccgactttcacggtgagtccctcggtatgatctcagtggcgaaaatcagctatcagattgaagtctatatgaaaaggaatcatacattgctggccatttccaaggtggataagctgctggcggtgccgacctcttcacaagatcatattccggattataaacgggtcatcagaagtttataaaatgaagaatggagctgaaagcaaatggaacaaaccaaggaaatgaagcagatcatcgctcaaattattcaggatattcaagaacagcagtcatatcgggccgtcgaagcgggagatgatgtgagagtcatagaggatctgggcttctcatcactggatatcgctcaattagtcgcacagatggagatggaaaccggagtggatcctttttcccaaggagaaacgatttccagcattacaaccgtcggcagcatttgtgatatttatcaaaaatacatggacagtgctcaatcatgaaaacagaaagcaggggagatatcagctgggtgactgataagcttagggaaacgcaggacagtgagtttctcatttttaaagggcagacttttacgtatgatgatttgctgacacgaatcagcttttttcagaaagaacttgaacaaaacggaatacgtgaaggagaatgtgtggcgcttatcggggattattccccgaacgccatttttttgctgatggcgcttttgttaaaccgaaatatcgttgtccctctcagcaatgaatcaagggaaaagcatctcgatatgtttgaagacgcgaaagtgaatcaaatcattgaaataaatgaaaatgacagctggacgcttcgtgaaggttctgaaagcgcctctcaccctctgcttgatgacctgcgcgagaaaggggagtcaggcattattattttcacatcgggaacctccggcaaaagcaaagcatccgtgttaagcgccggccggctgcttgaaaaatacaaaacggcgaagagaaaaccgctgcgtacgctcatttttctgaaattggatcatataggcggcattaatacgctgtttgcgattctgtttaacgggggaacgatcgtcacatcagacagcagaacgccggagtccgtttatcaggcggtcgacaaatatgctgtccaagtgctccccgccacccctacttttttaaacatgctgctgatgtccaaggcggatgccggctataacctgtcttcactccagctgatcacttacggcacagaaccgatgccccaatcaacgctgcgcggcattcaccggctgtttccggatgtacggctgaaacaaacatacggattaactgaactgggtatattctcaacgaaatcaaaagacagccaatccacttggatgaaagtaggcggtgccggaacagagaccaaaattaccggaggcacgctttgggtccgttctgagtcggcgatgctcggctatttaaacgcaccctcacctttcgatgaagacggctggtacgacaccggtgaccaggtggaaacagacggcgaatatataagaattctcggaagaaagagtgaaatcattaatgtgggcggagagaaagtgtttccggcagaggtggaaagcgtctttctggagatacctaatgtccgggatgttctcataacgggccgaaaaaatccgattacaggcgagattgtcgcggcagaggccgtacttgaaaaagaggaagatatcaaatctttcagaaagcgggccgtagctcattgcagacagaagctgcagccatatcagataccgcagatcatctctgttacagatcggaaactgtctaatgaccgatttaaaaaaataagaaacgtataaaacaggaggcaaatatgaataacggaaaagtagcggtcgtcagcggaggtagccgggggctcggaaaagcgattgtacaggcgcttttggatgagaattacaaagtagccgctttcagccgcagtgaatctgattttattaacacattgagagagagtgaaaagtaccgtgaccgcttttattgggaagcggcggatgcggcggatgatgccgccatgaaacagtttgttcttcaagtgtaccgcaagttttccagaatagacggcttggtcaataacgccggtttgaaccttgatcagctgctgcccctgaccaatgatgaagacattgaccgcatcctcaatctgaatatcggttcagtcatcaagctgacccgaaacgtttcccgggtcatgctgaaacaaaattccggatcaatcgttaacataagctccattatcggttcaagaggatttaaaggcacttcagtctacagcgcatccaaagcggctcttgacggcttgacgcgaagcctggccagggagctcgggtccaaaggaatccgtgtcaattcacttgcgcccggttttgtggacaccgatatgacgaaaaatatgccggaaaaacaaaaatcgcagattatcagaaggacgccgatggggcgtttaggcgaaacagacgatatgaccggactcgttcgttttctgctttctcctgaatcgtcctttatgaccggacagacaatggcaatagacggcggattaacttgttaaagcacagaaaaattcttttgtacaagggatggtatcctcatgaaatgtattaacgaatttttaagaacggtaatagcggaaaagctgggtgccgaggtgaccgaagcagaagataaaaccgctttttttactcttggcgtgacgtctctcatcagtgaagaaatcatgaccatattgcataaagaatttaccggcctttctgaaacgctgctgtttgaatatccgaacattgagaaattgagtgagtttttaagtgcgcagaaacgaaatcccgaaagcgttcttgaattcaaagaaacggagcctgatacgggaagccggcaggaagaagaagtgcttcctgtacaggcggctgaaaaggtgcctgaaccgggaacggacaggagttctgatattgcggttatcggaatgagcgggatgtttccgaaagcggaaaaccagcatgatttttgggacaatttaatggaaaataaagattgtgtctccgaaatccctgaggacagatgggacagctcttattactcggaagagaaaacggcaaaatacgcgtcatacagtaaatggggaggttttattgatcgtccggatcgatttgacccgctgtttttttctgtttccccgtgggaagctgatttaatggaccctcagcaaaaattgtatgtcacgtgctgctgggaagcgatggaggatgccggttacgggaacccggcggcgaggccgacggatcaaatcggtgtattcgccggagtgacctggaatgaatattcattaattgcacacgaagaaggtttcctcaaagatcagtataaaggccccggctccttatattggggcattccgaaccgggtttcttattttcttgatctccatgggccgagcatcgctgttgatacggcgtgttcttcatcgcttgtcgccgtccatcaggcttgtcaggccattatgtcgggcgactgtgaaatggcgcttgccggaggcgtcaacctcagcttacatccgcaaaaatacatgtttttaagccaatcgcattttctgtcttctgaaggaaaatgccgcagcttcggtgaaggcggagacggttacgtgcccggtgaaggcgcgggagccgttttgttaaaaccattgaaaaaagcgattgcggacaacgaccacatctacggtgtcattaaggggtccgccactaatcacggcggcaaaacgaccgggtatacggtgccgaatccggaagcgcaccgggacctgattttatccgctataaacagagccgcggtaagtccggcggatatcagctacattgaagctcacggtaccggcacggcactcggcgatccgattgagatacgcggtctgtctatggcatttgagaaacagaccgatgagaaaaatgactgcggaatcggctcggtgaaatccaatatcggacatttggaagcggctgcagggatcgccggtttaatcaaggtgcttttaagcatgaaacatgaaacgcttcccgccagtctgcacgccgaggaactgaaccgcaagatttctttttctgattcgccattttatgtcgtccgaaacaatcggccgtggccggctgaaggagataaaccgagaatcgccgcaatcagttcattcggcgcaggaggctctaatgcccatctgatcgtaggtgcttatcagccaaaacggcaagcggacgggaatactgagcaaaaaccgcatgccgtcgtactaagcgcacattccgaacagcagctgaaagaatatgccggaaaattgagctcctttcttgcccgattggaaaactcgccttctgccggcggatacagcctggaaaatatcgctgccaccctattgtcaggcagagagcctttctccttccggcttgctgtcattgcgtcatcccttcccgagctgaaacagcgattggacggctttgtgagcgggcacagcggcggcaggcatatttacttcggaaaagcgtcacccggacggccggacgtttcaggccaatccgtttcagatcctgaaaaatttgccgcgctgtgggtcaaaggccttcaaggtttcaaaaagccggagacgccgtatcagaaagttccgcttcctacgtatccgtttttaaaggaaacgtcctggctgaccgaccaaaaaaagcggtatacgaaaaagccccaatctgtcaaaaggcgtgaagcgctgcatccgctgcttgatgagaatgtttcatccgcccggaaagggacgtttcaaaagatattttccaaggatgaatatttctttaaagatcatttagtgaacgaaaaatatgtgctccccggagtctgtcatcttgaaatggcggcatacggcgcggcattgtggggagaacgcccggtcgtctctcttcaaaatgtgtggtatatggagccgattgtgacagggacagacccaagatccgtcatgatagagtttgaagcggaaaaagagcgtataagctatgtcattaaggaaaaaggagcggacggcactctcttttcgcaaggagaagtgatttgtaaagaaaatggagcgtcgtttgaggccccggtctttcagcttccggcgccatttacgcagagaacggagccgaaagacatctatcactcgttctctgaggcgggaatcgtgcaaaaggacagttttcaggtcatccgcgaattctcttatacagaaaggaaagcactggccaaattaacgctcccgtcacacttggaagcggattttaaacagtacatcctgcatccgtccttactggatggcgctgttcaaactgcaatggcgcatgtgctgcaatttcaaaaagagcctgcgcttatcgtaccgttttccttcggagaaatacagctgcttaaaccgttagcgaaaaccgtatttgtgcatgcggaggtaaaagcggcctccgttcaccaatttgatctgcatatttgtgatgagcgcggtgtgctgctggcggcagtgaaagattttatcataaaagaggtgcaggaaagcgccgggtttaaccaaaaagccggcgtcatgccgaagaaaagccgtgaaacggaattgcttatgacaccggtttggaacaccgtcaccattccggaaaccggcatgtctttcatgcgtgaagaaaaaataatcgtcatcgggggcgggccggattttcagcaggctttgaaagagatgtattccgatgtccgttttccggacatcacttctttggacagcgcggaacaaatagctgaaacactgaaagcgcaaggctcttttcaacacatgatatgggcggcgccggatcatccgattccatccgtttatgatgcggatacggccgacggacaggagcacggggtcatgcagcttttccggctggtaaaatcgcttctgcttctgaattttgacacggaacaactatcattgacaatctgcacgtttcaagcacagccgattcatgaacatgatgaggtcaatccgagtcatgcaagcatacacggattagcgggggcgctcgcaaaagaatacagcaattggagcatccggcttcttgatttggaatctcaaaggggagaccggcatcttcccgatatcttctctttaccggcggaccccgagggaaatccgtgggtctttcgtgcaggtcagtggcaccgccagcaattggccgtctgccagcctcatgcaggtgagccttcattataccggcacggcggggtttatgtgattatcggcggagcaggcggaataggagaagtatggactgaatatatgattcagacctatcaggcgaaaattgtctggatcgggagacggaaaaaagatacacagattgaaagaaagctgaaaagacttgcggctttaggtcccgcaccgcaatatttcagcgcggatgctgcggattatgattctctcaagcgggcgtatgacaccattgtgaaggaacatggaaaggtgcgcggaatcattcattccgccatcgtgttatcagaccggagttttgccaatatggaagaggaccagttccgcgcttcactttctgcaaaaactgatgtcagcttgcagattgcccgggtagctgaaggggaaccgctggatttcttgctgtttttctcttcgatgatgtcgtttcaaaaagcgccgggacagagcaattatgccgccgggtgcacgtttaaagacgcttttgctaagcggatctcacaaaaagcgccgtatgccgtaaaggttgtcaattggggcttttggggaagtgtcggcgttgtcgcttcagaacaataccggaaacggatggagcgggacggaatcgcttctattgaggcgcccgaagcgatgaaaacgctggaaaccctgctttcgggaccttatgaccagctggcgctgatcaaaacgacagatccggtttttatgaaagatgatctgaaagaacaagtaacggtttatccggaaaagattccttccgcactcggacaattagcggttaacatcacgcagaatgacgaagctgagcgggtaaaagcatcaaatgtcatgagctgcatgagagagatggaatccctcattgaaaaaatacttgtatcaaccctttatgagatgggcgcaaggcttgatgagactttgccgttatttcaatcggctgccggcataacggaacaatacagcagatggctgaaagagagctttgtcttcctgactgaattagcgcttgctccggaaaaaacggatctaggggaggtgtgggaggaatgggagcggaaaaaagagacttggctgcgccggaaagacatgagggcgcatgtcagattggcagaagagacattgcgtgtgcttccagacattttaaccggtaagcttccggcaacggaagtgatgttccctgactcctccttccgtcttgtggaaggcatttaccgcaataatatcatttctgattttttcaatgacaagcttgctgacacattgattgcagttttgcgggagcgtctggaaaaagacccgcaggcgaaaatccgcattttagaaatcggagccggaacgggcgggacgagcgccgcggtcatgagaaaattgaaaccgtatgaagcgcatattgccgaatattgtttcacagatatttctaaagtatttcttttacatgcagaagacatattcggtccggaatatccttatgtcacttataaaatattcaacgctgagcagccggtatcaacagaagcgccggacatcggcacgtatgacgcagtgatcgcgaccaatgtgcttcatgcgacaaaaaatatccgctctacgctgcgccatgcgaaagcaatgctgcaaaaaaacggccagctgtttataaatgagatcaacagccgcaccgtattcaaccatgtgacgttcggccttcttgaaggctggtggctgtatgaggatcatgatttacggattccgggctgtccgggggttgagccggccggctggtcggaagcgctttcacttgaagggttcgtccatcctctgtttccggctgaagccgcacacgacttaggccagcagattatagcggctgaaagtgacggaacggtcaggcttgccctcccgcaggcgtcagaagaaaaaccggagcgccgtccgtatgacgcagatggtctttcggatgatacattgcatttcagcttgagagaaaaaagcgttgaactgatgaagaaggtaatcggtgaagcgcttaaagtgccggcgcatcgtcttttatcccatgaacctttaaccgcatacggattggattccatactggtcgtcagactgaccaacgcgttaaaagacgtcttcggttctgtcagcagcactttgttttttgaatatcaaaccattgatgagcttgctgattactttctgtcttcccgtaaagaagcgctcgagcggcaattcgggaatggacgggctcattccgaaaacgccggacggatgcaggctcccgcagaaagcgccgcgccgattccaaacgtaagggaacggggcatcacatatctgacggaattaataggaaaaacgctaaagattccgagcaggagaatggatccgtcggtttccttaaccgcatacggtttggattctattctggtcgtcaggctcacaaatgcttttcgtaacgtgtttgaccaaatgaccagcaccctcttttttgaatatcagacgatagaagaaatcgcggattacctgcttctttctcagcggagagcatttatgaaagcgatgggtgtgcgtgaggagcagctgtctgatcacacagataacctgaatgtaattcctcaaaacgaggaagaaagcaggacaaacggagatccctatatccaggatatcgctgtcatcggtctgtcaggccggtatccgggcgccgatcacgttgatgagctgtgggaaaatgtaaaagccggcaggcattctattacagaagtgccgaaagatcgctgggactggaaaacgttttataacgaggaacgcggaaaatgggggtccatttattcaaaatggggcggtttcctcgatgacattgataaatttgatccgctgtttttccgtatatctcccgcggaagctgaaaggatggatccgcaggaaaggttgtttctgcagactgcttattcaagcattgaagatgcggggtacaccccggccacgctttgtgacagccggaaaatcggagtctttgtcggtgtgatgaacagcaattacccgacagttcccagcgactggtctatcgcaaacagagtatcgtttttgttcaattttcaagggccgagtatggctgtggatacagcctgttcttcttctttaacagctgtccatctcgctgcagaaagcctgcggagcggaatgagtgaaacagcgattgccggcggagtcaatcttatcgttgatccggctcactatgagcggctgtccgctttttcaatgctgtctcccggtgataaatgcaaatctttcggagacagggcggacggttttgttgacggtgaaggagtaggggcgattgtgttaaagccgcttgctcaagcggagaaagacggcgatcatatttacggcgttatcaaaggaagcatgctgaacgcagcaggcaggacaaacgcttatatggtgccgaatccgaaagcgcagtttgatctgatcgcagagacgttgaaacggacagacattcacccgagaacggtcagttacttggaagcccacggaacgggcactgcgctcggtgatccgattgaaatcgacgggttaacgaaagcttttcgcctgacaacagaagaccggcagttttgttccatcggttcaattaaatcaaatatcggacatttagaaagcgctgccgggattgcgggaatcaccaaactgcttctccaattgaaacataagaggattgccccttcattgcatgcggcggaattgaatccgaatattgagtttgagcacactccgtttttcgtacagcaaaaagaaacggaatggaaacgacctgtcttgaatatcacgggtgaaatgaaggaatatccgagaattgccggtatttcctcttttggagcaggaggggcaaacgcgcatatcatcattcaggaatatgtgccgtctgacagcctgaaaccaagggaaaacgcgtctgtttctccgcaaaaaccggctgttattattttatcagcgcgaaatgagcagcaattgacagagcgcgcccgccagcttctggatgatgtcataagaaaaaaacgttctgacggggatttggccaaaatcgcttacacgcttcaggcgggaagagaaccgatggctgagcggcttgcatttacggccgagtcgatagaagaactgaaaatgaagcttatgagtttctcaaacgatcatatcgaacatgctcatatctggcggggcaggacagccaaacatcattcattggcggcttcgctcacttctgatgaagatatggcgcttaccataaatgcctggctgaaaaaagggaaatacggaaagctgcttgacctttgggttaaaggacttgacgtcgattggtcagctctttatcagcgcaacccgggccgcatcagtctcccggcttatccttttgccaaagaccgatattgggtcacaaaagctgatgtgtcacttgacaaaacaggctcagcggaaagtgagaaagcagccagacttcacccgctgctccacgcgaatacatcgacctttaccgcccagcgctttacttctgttttttcagggcgtgaaccgttttttgccgatcacatcgtcaatggaaaaccggtgcttccgggcgcggctgctttagaaatggcccgggccgccgttacacttgccgctgagggcttgccgggcgggaaagcgggtgtccggctcaaacagatcgtttggctccgtccggtgacggcgctttctgaaggcgtgacgcttcatgtaaagcttcagccggaagaaaacggagacatcgcttttgaagcgtatgccgaaggagaagagccgcttgtctttttccagggaaaggccgtgctcgaagagacggagcgtgctccggtactcgatgtggaggcggttcaggcgcgctgcggcggccggcgcatgtcaaaggctgagtgctatgaagcattcgacagtctcggcatcacctacggaccgtctcatcaggcgcttgacgccgtctatgccggaagcggagaagtgctcgcgaagctcactcttccgccgtacgcccgcgaagaaaaggagccgttcatcctgcatccgagcatgctggacgccgccctccaggcttctatcggtctcgtgcactcagacggttccgcgtccggacggccgtttctgccgtttgccctccaagatatgcaggtgttttctgcgtgccgggagacgatgtgggcggtgctttcctcagcggacggcgcctatcatattgagctgtgtgatgaaaacggcgaggtatgtgtccgattgacggggctcaccgcccgttttctggaagaggaaacggagggaaaaccgctcttgcttcagccaaagtggcaggaatcaccgccgggtgaaggcggcggacaagcagagtctttcagatacgtgacgctgtatggcggaatgaacgctgaggacataaacggcgccgtatgtgcggctgacggggaaggtccgattgaagaccgttatgacgcctgcgcggcggagctgtcagcgatcgtcaagcgtcttatcaaagaaaaacagaagggaaaaacgctgatccagcttcttgtccccgacaggggggaagacaatgtattggcggggctggccgctttcctgaaaacggctcaccttgaacatccgaagctgtacggccaagtcatccaagccgatccggacgagccagcatcatcgcttcttgccaagctgaaagaaaaccggacgcaccctgaacaagcggaaatccgttatcaagccggcaaacgtctcgtcagaaactggcgtcacctgcctgcgcttcaaagcggcgccgttccgtggaaagacgaaggggtttacctcctcaccgggggagcgggcggcatcgggctgattttcgctgaagaaatagcctcccgcgtcaaaaacgccgtcctcatattaacgggaagggcggaagcgcttgataaagaccgctccgcccgcttacggcgcttggaagcgtcgggtgcccgcgtattgtatcaaccggttgatgtgacagacagggcggcggtcatcgccctcgtccgcggcatacaggaggagcacggaacactcgacgggatcattcacggcgccggcgtgatcgccgacaattacattctgaaccagacagaaaacgaacggaagaccgtcatggcgccgaaggtgaaagggcttatcaatcttgatgaagcagcgaaagatgcgcggctggactttttcattctgttttcttccttggcgggaggtatgggaaacccggggcaggccggttatgcggcagccaacgcatttatggacgtatatgcagcccgccgaaatcgtctcgtgcgggacaacaagcggagcgggcagaccctgtccgtcaactggccgctttgggaagaaggcggtatgcgcgtggacaaagagacagaacggctgatgtatgaacagaccggaatgaaagccatgcgatcggcttcaggcatccaggcgctgtacgccgcttttgcctccggagcacaccaggtcatggtggcagaaggcgacgagaaacggattcgaaaaaacctgatgcctgaagcgccggaaccgtcacgcagcattcatgtgtcaaggaagacccacgtccatctgccaaataaagtacaagcggaactcaaacatatgatatcaggcattctgaaggtgaaagaagaagaaatagatgctgaatcagagatgagagattatggatttgattcggtttcattcacgcagtttgcaaatgaactaaataaaatgtatgggcttgaactgacgccggccgtgttttttgaatacccgacagtctttagttttgcccaatacttgctgacggaacatccggatacattcggcccacaggaagaaacagaaacggagaaaccggttgagcgtaaaaaaatgaagacggagccattctcgattccgtcccgccttcctaaaacaaaaaccgcagctgaacctgaagagcccgtggcgataatcggaatcagctgtgcatttccaatggctgaaaatccggaaatgttttgggagaatttagccggagaaaaggactgtatttctgaaataccgccggagcgctgggactggagacagtattacggagatccgcagaaagataaaaatgcgagcaatgtaaagtggggcggcttcattgatgaaaccgctcaatttgatcctttatttttcggtatttctccgcatgaagccgaaatgatggatcctcagcaaagacttttaatgatgcatgtatggaaagcgattgaagatgccggctgctctgcaaaaagcctgtcaggtacaaatacaggcatttttgcaggcacgacaaacagcggttacgctcaggaagcttcaaagttccatatagagattgagggttcttccgctgccggaacggttccgtcaatcggtccgaaccgcatgagctattttctgaatatacatgggccgagcgaaccgattgaaaccgcctgttcaagctcattggtcgctgttcaccgtgcggtcagggcaattcaggccggagactgcggcatcgcgattgcaggaggcgtcaatgctattgtgtcgccggacatgcatatcagctttaataaagcaggaatgctcagtgaagacgggcgctgcaaaacattttccgatcaagcggacggctatgtcagagctgaaggtgccggcatgattgttttgaaaacattatctgatgcggaacgtgacggcgaccgtatttatgccgttatccgcggaacggcggaaaatcatggcggaagggcggcttcccttacatcgccgaatccgaaagcgcagacagaagtcatgataaaagcgtatcagcaagcgaacatcgacccccgtacagtgagttatattgaagcccacggcacgggaacggcgctcggagatccgatagaaatcaacggactcaaagcggcttttgcagcgctttatcaaaaagccggagtaacggcacccgatcagcctcattgcggcctcggttccgtcaaaacgaatatcggccacacagagcttgccgccggcatggccggacttttaaaaattattttgcagatgcagcacaaaacgctcgttaaaagtctgcattgtgaaaccgttaatccgtatatcagcctcgacggcagcccgttttatttcgtccgcgaaactcagccgtggaaagcggcgactgatgatagcggaaatgaactgccgcggagagcgggtgtcagctcgttcggatttggcggtgtcaatgctcatgtcgtgctcgaagaatatgtttctcctgttgaagagaaacaatggacggccggtgaacttcagccgtccttattcattctctcggcaaagacggcggaacagctgaaggaacgtgcggaacagctgcgcagatatttggaaaagtcacattcagctgacggagctcttgcggatatcgcttatacgcttcagcttggccgggatgaaatggaagagcgccttgccgtcattgctgaaacaaaagaagagcttacgaacgcgctgaatgatttcctcagcggcaaggagacggggcagaatttctttacaggccggaacaaagcgatgaaacagctgtttacagagatgacggacaatgcagaaatgagcggggccgtagatcaatggtttgaagcaggaaagtatgcaatgcttgcaaaattatgggtgcaaggcttgcatgttgattggagtaaattgtatcaggacgaaagaccgaaaaaagtcagcctgcctgtctatccttttgcgaaaacacattgctggataccgcacagtgcgcagcatataaggcaccgggagacttacgggactgatacgtccccgcttgagacttatgagcgcctgcttgatgaattggagaaaaacgaaataagcatagaagccgctgtaaaaagaacgatcggtttttacagggattagcgtaatggaggaaaccatatgaaagagtttctgcaccgggttttttctgacgtcaaaaataaaaaaatgacaaaacaggatgcgatcggcattttgcgcgattatgatatgcggatgggacttcgccaaacggattcccttcatccgcttgctcagcagcatatttccgatgaaacgggacagggattctcggcagctttcagcggccgggaattttttctcgctgatgtttctttacagcataaaaagcttatgcctggagaacttcttttggaaatggcgagagctgcggctgttttgacagtaaaggagactgcggctgtccggctgacgcatatcgtgtggtcaaagcccattctgactgaggctgagccgttccatatcgaaatcaggctgatacccgcagagggtgaagccaaaaggtttgagatttataatccattttctgctgattccagtcattatgatgtgtacagccaagggacgattcagccagttgatgctgcgcccggcatgctggatatcagccgcttgaaggaaaacagcggttccctgatggataagcagcaaattgaagccatcactcagaacgataccgttcaatacagtgagcacatgaaaggaattgagcgtatttacgcttcatcaggacggatgctggcagacatatcaattccattgacaaaccaaaaagaatccgcccgattcggcctccctccctgtgtgatgcaaagtgtgacagaggcatgcgcgctgcttggcggcaaagaatataaaacgctcgctccggtttcattggacgagcttttgttttatgaatcttgtcctgacaaggtatgggccgagatacaagagaaggcggggagcttttatattgatttatgtgacggagaaggaaaaatatgggcttctctgtcggggttgaagctgcagcctgtcatcaagacgggcgcttccggaaaaaccaatgccgaacaccgcagtgaacgtttgtatgaacaaacgcttcttcagctcaaaacgctttttggcctgactgcaaaaattgctgtttccaacatagatactgaagagccgctggaaacttacggaatcgactccgtcactgtgacgaaattgaaccgcgaattgtctctgcttttcggtgacctttccaaaacggttttttacgaatataagacactgggctccctggcagctcactttgtcacggattatccgaatgaatgccgaaaatggacaaatgatgatgagcaccgttcaggcatatcagaacaggttttggcaaatgaagattttccggtgcttccgtcgtttatcaagcgaagaaaacggcctgctttttccaatgagaaacagacaaaagaagggattgcgattatcggagtcagcggacgttatccgcaagctgaaacacttgaagagtactgggataacttagcggccggaaaagactgtgtgaccgaaattcccgaagagcgctgggaaaaggacaggtactacaaccctgatcccgaagcggccgtgaaagcagggaaaagttacagtaagcggggcgggtttctgaaagatgccgctttctttgatccgctgttttttcaaatttcaccccgtgatgctttgaatatggacccgcaggagcgtctctttattgaaatgtgctggcaggtgctggaggatgccggttatacgaaggaacagcttgagaatctgtataacggccgggtcggcgtttttgccggcattacgaaaaacgggtacggaatgtactggaaaaacggcggcaccctgcagccgaaaacgtcgttcagttcagcggccaacagagtttcctattttcttaatctgaaagggccgagcatgccggtcgacacgatgtgctcgtcttcgctgactgcaattcatgaagcgtgtgaaaacatccttcgcggcgcatgtgacatggcgattgccggcggtgtgaatgtgtatacgcatccttcggcttatgcggagctcagcgcctatcgaatgctttcaaaagacggaacgtgcaaaagtttcggtgaaggcggggacggatttgttcccggggaaggcgtcgggaccgtgctgttaaagccgctgtcaaaagcgatggctgataaggaccatatttacggggtgattcgcggcactcatatcaatcacggcggcagaacaaacgggtatacagtgccgagtccgagcgcccaggctgacgtgatttccggcgcgcttgaaaaatcaggaatacatccgcggatgatcagctgtatcgaagcccacggcacgggcactgaactcggagatccgatcgaaattgacggtttgacccgcgcatttcaaacgaaaacgtcagataaaggcttttgcgccatcagctcagttaaatccaatatcgggcatttggaagccgcggcaggcattgccggtgtaacaaaactgctgctccagtttcaaaaacgaaagctggccccttcattacattgccgaagcttgaatccgaatattgcatttgaccggacgccgtttgcggtgcagcgtgaattggcagactggaaacggccggtcattgaggaaaacggagcgcagaaagagattccgagaatcgcgggaatctcttcttttggcgcgggcggggcaaatgcccacatattgatagaagaatatattgaacctgatagggagatttctgagccattcacagatgaagatcccgcagtcattttattatccgccaaacaggaggccagcctgaagcagcgggcgcagcagcttcttcaagcgatcagaaaaaatgacgtcacagaccgcagcctccgggatgcggcttacacccttcaaaccggaagagaagcgatggaagaacgtgcggcgtttatcgtgacgtcgacagagcagttagcggaaaaactgcagtgttttattgacggcggaacagacggctgcttcaggggaaaaagcaaacagtataaagatattctagccgtttttaaggatgaagatatgcaggaagccgtccgtaaatggatgaaaagaaaaaaattcgcgaagcttctggaactttgggtaaaagggctgaagattgattggtcagagctttataacggcagcctgccgcatcgcgtcagccttcccggttatccatttataaaggatcgttattggccggacgatgcagcgccggacaatgttcgcggtgctgaaacacattctgaaacatttcgtgaattccgctttttacagaaaagctgggcagaaagcagccgtgttccggctaaggaagtgcggggcgtcatcggaatagccgctgatcaccagacaggaaatttggccgttgagctgtcccgttatttccccgagtctgaaatcattgacgctgcatcaccggaaatatccggggacgcggcccggtttggcggtctgattgatgtgacgggatgcgggacggaaatcaagcatgatgacggctggattcatcgtctgcagtctctcatcgacaacagaaaccgcggccgaaagctacagctgctttgtgtgacaaaggggcttgaaccttttgcgaatgaaacgataaatctctcaggtgcaaaaaaggccggattgtaccggatgctccaaagtgagtataaggatatccgctcgcggcatatggatgcagaacggactgccgaagattccgagctggcaaaccagatcgcagaggagttttttcgcgattctgcagacatcgaagtgtgttaccgaaacggtgtgcgctatcacgcgcggttaaaggaaacaaacagcttagctgaaaaagaattttcatttccgaaagaccatgcgctctggatcaccggagggacccggggactcggatatttattcgcccggcattttgccgaacgttacggagtcacgaaactcgtgcttaccggaaaagaaacaatgcctccgaaagcggagtgggatgatcatatcaaacggaattccccgttttccgataaagtgagaagaatcagagagctcgaacaaaaaggtgtccgaacggaagtgctgtctgtatcttccggccctgaatatgagcaggccgtcagccgggtgaaagagaagatgggaccgattggaggcgtgatacacgcagcgggagccgtagatctcgatcatcccgcctttatccgcaaaacaagagaacagatgatgactgtgcttgaacctaaaactgacggactggaccttttgtatcaagcgctgcacaaggagcctctccggttttttgcgctgttttcttcagtgtccggcgtgatgccggaattaggagcgggacaaagcgattatgccatggctaacgcctatatggattattttgcggccgcaaaaggttttccggtgctgagcatccaatggccgagctggaaagaaacgggtatgggcgaatcaaaaagccgggcctatcagaaaagcggtttaaagagcatcactgacagagatgggctgagcctgtttgatgccgttatggcaggcgattgcggatctgttattatgccggccgtcattcacccggaaaaatgggagcccgaccgtctgatgctttcaaccggccttaccgaaacaaagcagcatgtacagggtgagacagaaagcgtagaggagtggctgacgggcatttgctgccgggaattaagactggagccgtcaagatttgaatctgatacaccgtttcaagattacggagccgattctatcatgcttgcccaagtgtccagagcgatcggaaagaggatcaaagctgaccttgacccggcggtgctgtatgaataccctacggttgctgcgctggcgggatggcttgaaacggcatatccggaaatcaaagctgccgtttcaaaaccggttcagcctgtaatcccggacgttcccaaacaaacagcagccgctgtcattcagccttctggcgctgcagcggcgcaagacatcgctgttgtcggaatgtcctgccgttttcctggagctgaatcaattgaagcttattggaagctgctgtctgaagggtcgtcggctattcaaagggtgccgaaagaacgctggaaaacggagaaggcggattatgcgggccttttaaaaaatgtaacgcattttgacccggagtttttccttattcccgaagaagacatcaaggcaatggatatccagtcctttcttatattagaagaggcgcttcatctgttcagagacagcggttactctttacaagaaatgaaaggcaggtcagccggtgtctatttaggaggacgcggcggcagtatgcctgacgaaaaccgtctgaagcatgcaaaaaatccgatagtcgccgccggcccgaattacttggcggccaatctttctcagttctttgatttgaaggggccgagtctcgttttggatacggcctgttcttcagcgcttgtcggtatgaatatggcgatacaggcgctttcttgcggtgaaatcgactcagcggtggtcgggggagtcagtctgctggaatccggtcaaacccaccggatgttcgaacttcgcaatctgttaagcgaagagcctgcgtttcatatttttgaccgccgcaccggaggcatcgtattgggagaaggcgtcggaatggtgtatttaaaaacagcggcccaggctgtaaaagacggggaccggattcatgcggtcattaaaggcatttccgtaaacaatgacggcagaaccgcggggcctgccacaccgaatatacaggcgcagaaagaagtgatggccaaggcgcttgccaaaagcggcagaaaagcggaggatatcagctacattgaagcaaacggttcaggctctgaagtaaccgaccttttggaactgagggcgattgaagcggtgtaccgtatgcaaaacagcgcgccttgcgaattggggtcgatgaagccgaatatcggacacccgttatgcgctgaagggattgccggattcattaaaacagtgcttatgctctcgcgccgaatgcgtgtgcctttcctttcgggcaaagagccgatgacgcattacgatctgtccgcctcgccgttttatttttcgcacgttctgcgtgaatggacggattcaccgcggattgccgccgtcagcagtttcgctgacggagggacgaatgcccatgtcatagtggaagcctgggagcaggaggcgtataccccggttagaaagcctttgccgagacaggaattaaaacgccggcccatccgtccggacaaagctgaaaacctgcatgaaaacgcacatgaatcccgcccgaatacgttttggaaacaaatgaagacttactgattgcgctgaaaattgaacgtcgatatggaggaagttcatatgcaagagcagcttcttattaacaatcagcatcccgttctgaaacatcataaagcctatggaaaggaactgctgccgggtctggcttatattgacctgatctatcagactttcagagaaaacggtttttttcatgccggccttgaactcaggcacttatcgatttttcaccctttagctcctgaacagggagaaacaatcctgctttccgttgactgtacagagaacggcgaagggcagtggaaggtagaggtgaaagggcaaaaacaaggtgacgaagcagcagagacaaagatatatgccgcggcgcaaatgcattccgtcaagcccgccggcttccaagagagcgtccggatggatgccgtaaaacaaacggcggcagaaataccgcttgaggatatttacgcggaatgcagggatcaagaactggttcattcaggaatgatgaaaggctgcggaagcgtctaccagactgaaaaagagatttatattgatctgtcggtgcaaaaggatcagctggaacatgcagaagaggcgatgtttcatcccgcattgatagatgcgagcagcatcggctccaatgtatatctcgctcctttgacgagggaggaggggcaattatttctgccgctgttttatgaatcattttattgcgccgaattgctgcagacgacatgtatcaccaagataaaaaaagaatccgtcacacgtaagaaagatctcgtttacgtgacaatggagtttttcaatgaggaaggcagaaaagtcggcgaactgaaaaacttcgccaataaacgggtgagggacccggaactgatcaatcagaaacggcaaaagaaagaacctgacgggcggaatgccgtcccggctccgcaagcggaaccggcgccttccgagccccgccgtgcggaggcttccgccggccttactgaacagtgcatcctttatttaaaagaattgcttgccgcccgattgaacaaacctgtgaaagagattgacccggatatcggctactatgaaatggggctggattctccggggctgttggacatggtaaaggaaattgaacgaaaaatcggaacgcagcttctgccgacgctgttatttgaatacacgacaatcgcggaattggcgggatatttgcgcgaacattacggagccggcttcggccatgctcaaagcgggcatccaaatgctgaacctttgcgccgggaaaaaaagaggacgacccaaaaccgcgtgaaaaaatcggcgtcagccggaacgcagaatggagatattgcgatcgtcgggatggcgggacggtaccccggcgccaaaaatcttcgtgaattctgggcaaatttaaaaaatggagaaaacagcgtaacggaagtgcctcgttcccgctgggatacgaggaaatatgagcatttgcgatcgccgtccggcaagccgatttccaaatggggcggttttatagacgatccggattgttttgatgcgaaatttttccggatttctccgcgggaggcagaagctaaagatccgcaagaacgattgtttttagaaacatgctgggaaacgattgaggatgcaggctataccccggaaacaatcgttcagccgaaagggccgaataagagaatgaacgtcggtgtgtttgccggggtgatgcatatggattattctctcgccggcgctgaagctgcggccaaagggctggtctttccttatcccttgaactatgcgccgatcgcaaaccgggtttcatatttctgcaattttcacgggccgagcatggcggttgacacggtgtgttcgtcatctctgacggccgtccatatggcggcggaaagtctgagacgcggtgaatgtgaagcagctcttgccggaggcgtcaatttatcattgcacccgacaaaatatatcacatacggcttgatggatatgcattcgagtgacgggctgtgccgcacgttcggcgaaggcggcacaggctatgtctcagctgacggcatcggggccgtgctgctgaagccgcttcacaaagccgaagaagataaggatcatatttatgcggtgataaaaggcagcgccgtcaatcacgtgggaaccgtcagcgggattaccgtgccgagcccagtggcgcagggggatatgatagctgaatgtcttgaaaagacggggatcgatcccaggacgatttcttatgtggaagcgcatggaaccggaacttctttaggagatccgattgaaatacaaggtcttgttaaagcttaccgcacgtttacggaggatcggcaattttgtgcgatcggttccgttaaatcgaatatcggacatgcggagtcagccgccggaatcagcgggcttcataaaacggttttgcagctgtttcacaaaacgcttgtcccttctttgcactcagagacgattaatccgtatctccgtttagaggactcgccattttacgtgcagcaaaaaaccgagtcatggaaaaagccggcgtatacagagaacggcagagaacattcctgtccgagacgcgcaggcatcagttcattcggggcgacgggttcaaacgttcatctcattttagaagagtacaggcccaaaaaccccggcattacggagaatcaagagagaccgtatatcgtgcctctatcagcgaaaaatccggagcggctgaaggaatacgctgcccgcctgctgatgtttctcaaagataaagcgcttgaaggaagcgggtcgctttatgacaaaacagatacaatgcaaaatcagctggaaaatgcgctgcgcggtgctctggcggaagttctgcatgtagaggccggctcggtagatggtgaacaggattggaaggaattcggcttggatgtcatgcagctgacacagttttctgagcggctgacggatcaatacgggctggcaatagacatgactgatctcatacagcatacttccgtccggactttagcagaatgtctgacaaacgatgagaaacataagaatattctttccggtcttttcggtcagtccggcttagagaagcagtctgatgaacctttttccctgcggtcactggcgtatacgctgcaaacgggacggctggcaatggaagaacggcttgtttttttagtgaacgatcaagcggacctgatcaggaaattaaccgaatttacagaacgaaaacggcagattgacggctgctttcaaggccggtctgatagcggaacggaaatcaggggtttcctgaatgatgatcaggatacggaggagctgatccgaaaatggacggacagcggcacttacaaaaaacttgcggagctgtggtcaaaaggatttgagatagactggacgcggctgtatcgggaggagaaaccgcgcaggatgagtctgccgacatatccgtttgcgaaggagcgctattggataccggagcccgatcatcccgtcacttccgtaaatacagaaagcaggcttcacccgctgcttcaccgcaatacatcagatttgttagaacaaaaattcagcacggtactgaacggagatgaattcttcttagccgatcatatcgtccgaaacaagcgtgttctccccggggcggcttatcttgaaatggcgagagccgcggctgaactggctgccgcgccgttagccgctgaatacacggctaaaaccggcatttcgctgcggtatatcagctggatacgccaggccgttcataaaaaagagccgctgcgtatgacgacaggtctttccttagaggataacggcaatatttcatttcaagtgtacagcaatgaaaacgattcagacatttattgtgaaggcagtgctgtgattgagccgctgtctgaggcggcggttttgcatattgaacagctgaaagcgcgctgccgcaaaaaagtgctgtcaaaagaagactgctatgcggcatttgcaaaggcggaaattgtatacggaccttcacatcaaggaattgatcacatttattgcggggaaaaagaagccttggctaaattggtgctccctgcttccgtttgtgatgaggccgaacagtttgtgctccatccgagtctgattgattccgcttttcaggcggccatcggcgttatgaatgaagataaagcgggttatccggagcagccgttaatgccttttgaattgcatgaactgaccgtttttcatccgtgcagtccaaacatgtgggcggccgtatttgtgacgcatgaaacacgggccgtgcgaagaatggacattgatatatgtgatgaacgcggcaatgtgtgtgtaagaataaaaggattttctgcccggatggccgaaagtgcgccggccgtaaccgataataagcaatacgatctgccgggtaaccttaccggagccgtcaaactgatgcaggtatgggacgcggaaccgatagacaaccaaaccggcttccccatttctgaagcaaaagctgtcatcataggcggtacagacgggcaggcggacgcggttttacgattgtttcctaaagctgtgcgatttgatagcagccaaagtgcttccgttgaagtgatatccgatcggctccgccgtgtcggtgagattcagcatatgatctggtttgcccctcagccggctgattcttacatccatgatcaaaaaagcggggtgctgcaaattttcagagcggccaaagctcttatcggtctcgggtatggaaaagagcagctcgggatgacggtgattacgcaccaagcacagcctatcacccaatatgatgaggtgcgtcccgctcattccagtgtgcacggtttcgtcgggtctctcgcaaaagaacatccgagctggcacatccgtctggtcgatcttgaagacggggggatttccctgcagaagacatattcagcctgccccgcgaccgtacgggtaaagcatgggtgcgcagacatcaggaatggcaccggcctcaattgcttccggtccaaagcgggccgtctgaaagtgttccttaccgatatggaggcgtatatgtcatcatcggcggtgcgggaggcatcggcgaggtttggacagattatatggtgacggcgtataaagcccgagtcgtctggatcgggaggcggccgctggacagccggatacgccaaaaaatagaccggtaccggccatcaggcccggctcccgaatatatagcagcagatgcttctgatcttccatcgcttcagcgcgcctatgaacagattaaaaacacatacggcaccatcagcggcgtcgttcattcagcgatggtatttgcgaatgaaagcgtaaaagatatggaagaatcacagtttcacgccggccttgcggcgaaagtggatatttccgtcaacattgccgaagtatttgcgaaagagtctttggactttattctctttttctcttcggttatttcatatattaagaatccgaatcaaagtcattatgcggcggggtgcgcatttaaagacgcatttgcccatgagctttccgggcggctgtcatgcccggtcaaagtgatgaactgggggtattgggagcgggctgacaatcacatttctgaagagtttgacagactgagtgcaatcggtctcggactgatcagccgggcggaagggatgcaggcgctggaaactctgctgacgcagccgatctcccgcatggggctgatgaagctgaccaagccgattccgatcgagggaatgaaccctcatgaatttgtgactatctgattgcctgtcaaaatgacggagcaaatttaattttcttaggaggataaggttttgggtaagggagacaaacaaaaagaccgtacacagttatccttaagaacagaaataagcaatcaaatgaaagaattgaatcagcttttgctgcaagtgctgcgggtgacgctgcgttcaatgggtctgaccggcgaagcgccggcggcttcctgtctgcctttatatgagcgctggctggaagaaagcatccgtcttttagacagcgatcttaaaagcggtgaaacggccgcgatttgggaagagtggcataagaagaaaaacgaatggctgaaagatccggatatgaaagcgcaggctctgctggcggataccgtcattcaagctttgcctgacattttaacaggcaaaataaaagccactgacgtgatgtttcccgattcttcaatggagctcgttgaaggaatctataagcataacattctcgctgattattacaacgatgtgatggcaaatgaagcgtgtatttatgtggaaaatgtaattaaaaacaatcctgaggcaaacatccgtctgctggagatcggagcgggcaccggcggaacgagcagcacactgtttaaaaagctccgcccctatcaaaaccatattcaggaatactgttataccgacttgtcaaaagcttttttaatgcatgccgaaaaggaatacggcgcggacaatccgtatttgacgtatcagctgtttaatgtggagaagcctgcggcgggccagggattacatctgagaacctacgatatcgctatcgccgcaaacgtgctgcatgccaccaaaaatatccggaaaaccttacggacggcaaaagccgtattgaaaaaagacggtttgctgctcgttaatgaactgggcggacatacgccgtttacacatgttacattcggcttattagagggctggtggctgtacgaagacgaggcgctgcggattccggggtgccccggtctttatccggaaacatggaaatcggttttaatggctgaaggctttcattccattcaatttccggctgaaaacgaacgtctgcacacccagcagattatcacggcgaaaagcaacggagtcatcaggcagagcagggaagcttacaccgcgcaaaagcgccaatcaaacgtaccgcgaacattctctgatcgtcagctccccatcaaacaagcgggagaagggctttcggaaaagacagctgcttttctgataagggctgcggcaaaagtattaaaaatgccggcagaagagataaatccgctggctcctctggatgaatacggtattgactctattctgatcgttcagctgacgaacgagctgcgggatctcgtccctgatatcagcagcacgctgttttttgaacaccgaacgatagaagagcttgccgcatacttggctgaaacgaaggagcgcgaactgcttgcgcgattttctgaagaagtccgtcatactgaagcggtatcatcaggctctttgcttgaaaaaagcacagagtatctgaaacagatcgtcagcgtcatcttaaagatgccgattgaggacgttcaagcccatacgccccttgaagaatacggaattgattccatcttaatcgtacagctgaccaaccgcgtgcgggaagacgtccctgatatcagcagcacattgttcttcgagtatccgacaatcggcggattagcggaatatctcgtcagctcaagacaggaagatatggctgggattttcaagacaaataaagaagccgaaaaggtgccgcacactctacagaaaaagcaaagccgcaaaaaaagcgccggattgacgaagcgccaagcggcatctttttctgaaaaagcgccgcccgcctccgaaccgccgtcaaaacaccttgaagtggcaattgtcggtcttgccgggaagtatcccggagctgaaaatgttaatgagttctgggaacggttaaaaaccggtgaacacggaatcaccgaaattccgaaagaccgctgggattggcgggactactatgatgagacaaaaggtaaggaaggccggatgtatacaaagtggggcggctttttaacagacattgataaatttgatccgctgttttttaaaatctccccgaaagaagcggagcgcatggacccgcaggagagactgtttctggaaaccgcttatgcggcccttgaggatgccggatatacccctgattcactatgcgccggtaaaaaggttggtgtttttgcgggtgtcatgaacggcaactatccgacaggggcccactaccactttatcccgaaccgcgtatcctatgtgtttgattttcacggtccgagcatcgcggtcgataccgcatgctcctcatccttaaccgccattcatctcgccgcagaaagcatcagaacaggtgcatctgaatgcgcgattgccggcggcgtaaacctgattacagatccggttcattatatcggactgtcttctatgagaatgctgtcgccgtcaaacgcgtgcaaagcgttcggtgataaggctgacgggtttgttgacggagagggcgtcggctgtatcgtgttaaagccgttgaagaaggctgttgaagatcatgatcatatatacggtgtcattaaaggaagcgctctgaacgccggcggcaaaacgaacgggttcaccgttccgaatccgaatgcacaaggggaagtgatcgcagacgcgatggagcgggcaggaattgacccgagagcgatcagctatctggaagcccacggcaccggcacttccttgggagatccgattgaagtcgcggggttaaccaaggctttccgccgctatacggatgcaaagcaattttgttccatcggttctgttaaatccaatatcggacacctggaaagtgcggcgggcattgctgccgtcaccaaaattcttcttcagatgaaacacggatatctggtgccgtcgctgcattcaaagcagctgaacccggaaattgattttgaaacttctccttttatcgtgcagcaggaaacggcggaatggagacggccggtcatagaatctgaaggagtaacacgggaatatccgagaatcgcgggtacatcttctttcggagcgggcggggcaaatgcccatctgctgatagaagagtatgaaccggctgaaatgacttcggcggactccggccgtccggcgctttttgttttatcggcaaaagataaagaccgcttgcgcgagcgggctctgttgctgtcggatgccgccggaaacggaacaattacagatgcaaatctgcttgacgcggcatttacccttcaagtcggcagggttcagatggaagaacggctggcgatgacagcggactctgtttctgaattggaacagaagctgactgcttttctgaataatgccgattccgtaagcggggtgtttacgggccggagtgatagtgctgtcacagagacggaaggcacagtcggtgattggatggaaaaacgtcaatttggcagtcttttgaatgcctgggtccacggggcgcccgtcgattgggcatctttatataaaggcgcgctgccgcatcgtatcagtctgccgtcttatccatttgcaaaagaaagctactggatgaagcgggaagaaccaaaaacaggaacaactgaatatgtgcatcctttcctgcatgaaaatacgtcaaccttggcggagcaaagctatcatacatcttttacaggccgggaacacgttttccaggatgtgagaggagagcgggttctgtcggcagccgtttatttagaaatggcgcttgcggcttatcatcatgcggcagacagctctgaagaaaaagagatatggatccgaacggcggcatggactgacccgattaccggcggacatcacggtgcgggcgtcaatctctcccttctgtctgaagacgaggaaggcatccattatgaaatatacagtgatgaagagaagctgcatcattatggaatcatcggtcaagggaacgtacagccatcccgcatgcttgatattgcctccttacaaaaagactgtcgcccgctgtcattcgattatgaaacaccaggcacatcaggtgtaacgatcagtaaggagttccgcaccgttgaaaagctttatacgggagaaaatgcgatttgggcgaagcttgctcttacagatgaaagcggccgtaatccgggatatcatctaccgccggaatttctggacgcagcttttcatgtcttggcaaaaacggagccgtcagtccatatcgtgcctgaaacggttgaagaactgcgcgtcatgcgtccgtgttcatccggcatgtggatgtatatgaataaaaagaatcaaaccggctgtgacattcaattttgtgacgaaaccggcattgtatgcgcagaaatcaaaggggtgagaatgagacagccgtctcagcaggatcacgggcaagaggaacactccgagatgatgatatttgaagaaaggtggacgcagcagcctctgaagaaatccattcatgaagagctgaaaacggtcatctgttttcttacgggagaagctgccagaaaacatgcttatcggtctttacaatccctttatccgggagccggcgtgttttttatttcacagggtgaggaaactcaaaagctttcaaacacgcattatcaaattaaaatcactgacggacaagcatatcaagaaacgtttcggcatattgaaacggctgcaggcaaggcggatgccgttttgtatggatggccgcttgaagatgaaaaggccgtgaaagactattccattctgtatcatgtgatccgcgcagctgcttctttgcgttctaaaccgaggcggatccttctttccgctcagtgcgggaccgaaaccgatatcagttacgccgagtcatggatcgggctggaacggtcgctgaaactgatcctgccggagacggatacggccgcggtttattttggacaaagaggaccgtttgaaaagctgatccataatgtatgtgaagagcttcacagcgggtcgttccgcagtgtcatgtacagtggggaaatccgtcacgtcatggaaatgaagcagacggatattgcccctgttgagaggcgtgtgataaaaagcggaaaaacgtacttgattaccggcggatgcggaggtttgggcttgttatttgccggatattttgctgaaaaaggaccggttacgctcattttgacggggagatcagcggcaggcggcccggtgctgcacaagataaagagattggaagaatcaggcgccaaggtgttttacgtgcaggcggatgccgcagatcaggctcagatggagaaaggtttgcaagaagcgaaagagaaaggatgcgggccgattcacggtgtcattcacgctgcaggtcttcaaggcactgaaagcattctggagaaagatctgcaaacctttcagcaagtcttatcgccaaaaacggacggcacagcggtgttagatcaggttctgtcacgggagccgcttgacttcttctgttgtttctcttcttcttcagcgattttaggagacttcggttcttgtgactacgcaatggggaaccgcttccaaatggcttttatccgccaccgggataaacttgtgagcctcggactcagaagcggcaagtcacttgcaatcaattggccgctttggaaagaaggggggatgcatgtcggcacggcggaaagcaccgatatgtatttaaaatcaagcggacagcgttatttatatacaaaggaaggactcgaagcttttgaaacattgttagtccagccgtccagccagtatctcgtcctggccggttttccgtcgagggccaaacgcttcctgcagatagatcaaggcgaacggccgatttcgggttctgtaaataggaacgtcccgttttcaggaaggcggagtgaaatgaaaggctttacactggaagaatgcgtaagctgggatgtgaaggaactggcggcggggcttttgaaaatagacaagaacagactgacggatgctgacaatctggctgatttcggctttgattctatcagtttggcggaattcgcctcttctttgtccgctcactacggaattgaagtgaccccggccctgtttttcggacattccacactggagaaggtcgtccgctattttctgacggaacacaagtccgtcatagagcatgtctatgaagaaaagaaacctgaatccgcagatcaatctgtctttgaaaaggcaggaacggaaaagcgaaagaagcagaggggaagaaataagctgaacgccggaaccgagggcagtcaggcagctgattccattgccattatcggcatgagcggccgctttcctcaggcgcgcacggcggacgagctgtgggacattctgtttcaggaaaaggacgttgtcgcaccggtcgcaaaaaaaggcttcacaagttcaaaatggaaactcggcgctgtaccgggggcggacgaattcgaccctttattttttgaaatatcgccgagggaagctgaaacgatggatccgaagcagcggctgctacttcaggaagcgtggcgggcccttgaggatgccggctacggcgccagtcacatcaggcagcagacgatcggtatgtttgtgggtgcggaagaaggagattatcaccttttaacacgggacaaaggcaatgtcacgtctcatcataacggtattttggcggcgcggctggcttatcacttgaatttatcaggtcctgtgatggcgataaatacagcatgttcttcggggctcgtttctgtccatcaggcggtattaagcctgcagaataaagagtgtacaacagctgttgcggccggggtgaatatcatgaataccccggacttttttgaaacgatagataaagccggaatgctgtcggaaaacgggaaatgcttcgcgtttgataaaagggctgacggcctggttcccggggaagcggctgcggcggttgttcttaagccgctgagagaggcggaagaagatggcgatccgatttacggggtgattcgggcgagcggcatcaattatgacgggaaaacaaacggaattaccgctcctagcggcgtcgcgcagacccggctgcttacttccgtttatgaccggggccgtatcaaccctgaagatatcgaatatatcgtcacacacggcacgggtacaaaactcggtgatccggtggaaattaacgcgctttatgacgcattttctgcctatacaaacgaagaagcattttgcgcgctcacatcaattaaaaccaatatcggccacacgtttgccgcgtcaggcattgtcagtttgatcagtcttttacaggcattctcccgtgaaatgattcccgccagtctgcattgcagcggggaaaaccgctatatcaactgggagaaaagtcctttttatgtgaataaaacggctaaagcgtggccttctctgccgggtaaaaaccgaatgggggcagtcagcgcattcgggatgagcggaacaaacgcccatgtcgttatggaaagctataagcgcagcgcttcacctcatccggatgcccctgcttatttactgactttatcagcaaaaacaaaggaggcccttcaggaaaaaatcgaagatatgatcacttgggcggaaaatggcggactgaaagaaaatgatctagcccagctcagctatacgttgctaaaaggacggcatcactttaaccatcgcgccgccatcgtggttcaagatgctgatgacgcagtgtatgtatggaagcaggcaaagcttaatgaacatcatccttatgtgttttcgggaaaagtaccgcagcactttgcaggccgacagcatattcaggagcacataatagaagtgctcggcaagtgcagcgcttcatattctgaccatagaaaatatcaggaactgttatgcgtgctggcagatttttattgtcaaggttatgaaattgaaggggacttgctttatggcggacctttgccgcgaatcggcaatctgccgggctacccgtttgccaggcagacgtattgggcgtccgatcgtcttcagggagagcttgaaagccggaattcagctgaacgtgaaaagcttcacccgctgctccatgcgaatacatcgacctttaccgcccagcgctttacttctgttttttcagggcgtgaaccgttttttgccgatcacatcgtcaatggaaaaccggtgcttccgggcgcggctgctttagaaatggcccgggccgccgttacacttgccgctgagggcttgccgggcggaaaagcgggtgtccggctcaaacagatcgtttggctccgtccggtgacggcgctttctgaaggcgtgacgcttcatgtaaaacttcagccggaagaaaacggagacatcgcttttgaagcgtatgccgaaggagaagagccgcttgtctttttccagggaaaggccgtgctcgaagagacggagcgtgctccggtactcgatgtggaggcggttcaggcgcgctgcggcggccggcacatgtcaaaggctgagtgttatgaagcattcgacagcctcggcatcacctacggaccgtctcatcaggcgcttgacgccgtctatgccggaagcggagaagtgctcgcgaagctcactcttccgccgtccgcccgcgaagaaaaggagccgttcttcctgcacccgagcatgctggacgccgcccttcaggcttctatcggtctcgtgctctcagacggttccgcgtccggacggccgtttctgccgtttgccctccgggatatgcaggtgttttctgcgtgccgggagacgatgtgggcggtgctttcctcagcggacggcgcctatcatattgagctgtgtgatgaaaacggcgaggtatgcgtccgattgacggggctcaccgcccgttttctggaagaggaaacggagggaaaaccgctcttgcttcagccaaagtggcaggaatcaccgccgggtgaaggcggcggacaagcagagtctttcagatacgtgacgctgtatggcggaatgaacgctgaggacataaacggcgccgtatgtgcggctgacggggaaggtccgattgaagaccgttatgacgcctgcgcggcggagctgtcagcgatcgtcaagcgtcttatcaaagaaaaacagaagggaaaaacgctgatccagcttcttgtccccgacagggggaagacaatgtattggcggggctggccgctttcctgaaaacggctcaccttgaacatccgaagctgtacggccaagtcatccaagccgatccggacgagccagcatcatcgcttcttgccaagctgaaagaaaaccggacgcaccctgaacaagcggaaatccgttatgaagccggcaaacgtctcgtcagaaactggcgtcacctgcctgcgcttcaaagcggcgccgttccgtggaaagacgaaggggtttacctcctcaccgggggagcgggcggcatcgggctgattttcgctgaagaaatagcctcccgcgtcaaaaacgccgtcctcatattaacgggaagggcggaagcgcttgataaagaccgctccgcccgcttacggcgcttggaagcgtcgggtgcccgcgtactgtatcaaccggttgatgtgacagacagggcggcggtcatcgccctcgtccgcggcatacaggaggagcacggaacactcgacgggatcattcacggcgccggcgtgatcgccgacaattacattctgaaccagacagaaaacgaacggaagaccgtcatggcgccgaaggtgaaagggcttatcaatcttgatgaagcagcgaaagatgcgcggctggactttttcattctgttttcttccttggcgggaggtatgggaaacccggggcaggccggttatgcggcagccaacgcatttatggacgtatatgcagcccgccgaaatcgtctcgtgcgggacaacaagcggagcgggcagaccctgtccgtcaactggccgctttgggaagagggcggtatgcgcgtggacaaagagaccgaacggctgatgtatgaacagaccggaatgaaagccatgcgatcggcttcaggcatccaggcgctttacgccgcttttgcctccggagaacaccagatcatggtggcagaaggagatgaaaaacggattcgcagccatgttttcgatctgcgtgaagaacaaagcgccgccgcaaaagctccggcagagacagatgcaggagatctgaaagatcgggttcaagagaaactaaagcgtcatgtatcagatcttttaaaggtaagcatgaaagatattgaggctgacagcgaactgacggaatacggatttgattcgatcatcttcactgaatttacaaatctattaaatcggtcttatcagcttgagctcagcccgactatcttctttgaatttccgacattgcgcaaactgagcggccatttgatatctgaatggaaagaagcattcagcggcttagaaagagagaattttaaaaccgccccaaaagccggaataagaaaagctgaagctccggcggccgttcatgtcaaacgggaaacgcccgtatccgtaaaaggaaaatcagaagaaaaaaccgaaccgatagccattatcggaatcagcggtatttttccgcaagcgaaagacatagatgaattctggacacgtttatcaaaaggagagcattgcatcacagaaattccccgggatcgctggaattggcgcgaatattacggcgatccggcagcggatgcaaataaaacgtcaattaaatggggcggttttatagatggaatcgccgggtttgacccgctgtttttcgggatatctccgaaagaagctgaaatgatggatcctcagcagcgcctattaatgatgtatgtgtggaaagccattgaagacgcggggtactcggcaaaacggattgccggaacaaaaaccggcattttcaccggcacattgggaagcggatatcaaaccttaatcaataaggcgggtcttcctgtcgaggggtatacgatgaccggaatcgtgccgtccgtcgggccgaaccgaatgagttattttcttgatatccacgggccgagcgagccgatagaaaccgcttgttcaagctctttagtcgccattcaccgcgcggtaaaagccattgaaacgggagattgtgatatggcggtcgcaggaggcgtcaacacgatcgtcacgccagaagggcatatcggttttcaaaaagcaggcatgctcagtgaagacgggcgctgcaaaacattttctgatcaggctgacggttatgtcagaggagagggtgccggcatgattgtcttgaaaaagctttcagaggctgagcatgacagggatcacatctacggcctcatccgcggtacagcggaaaatcacggcggacgctcagcgtcacttaccgcgccgaacccgcaggctcagacggatgtgctgaaaagcgcttatcaaaaagccggtattcagccgtcaacgatcacttatatagaagcgcacggaacaggtacggcgctcggagatccgattgaaatcaatgcattgaaaaaagctttccaaacagacggggctccgggcggatattgcgggattggctcagtgaagacaaatatcggacatttggagctcgcagcaggcattgcgggcgttatcaaagtattgatgcagctgaaacatcggacgctcgccaaaagtctgcattgcgagaacatcaatccccatatcaaattgaaggacagcccgttttacattgtgacagaaacaaaggagtgggaagcgctgcgtgatgaaaacggccgggtcctgccccgccgggcgggtgtaagctcattcggtttcggaggcgtcaatgcgcatatcgttattgaagaatacatgggcaaaagtgagacggaacagccggaaacccgtgagaaagcgtcatctctttttgttttgtcggctaaaaatgaagagcggctgaaagaaagagcgcgtctccttcgcgattttatccaaaacggatcatcccgccatatcgatcttgcagatgttgcatacacactgcagaccggacgggacgcaatggaagcgaggctgggaatcattgcaggctccgcagaggaactgactgaaaaactgaacgcgtttctgacgggaaaaaacagcgaagatatcatcagcggccgtaaaaaacgcgagaataacacgatctccatgttctcagacgatgaagacgcagctgacctcgtcagcgcctggattgagaaaaagaaatacaagaaagtgctgcggctctgggtaaacggatttgacacagattgggagcagctgtatacggacagtaagcctcgccgcatcagcctgccctcctatccgttcagagcagaccgctattgggtgccgaaacgggagcagctgccgctttcgaatcaaaaaacagtagtattgcagaaaacatgggagccttgcgaggcagtgtcttcatccgagccattcagcaaaatagcgctcatcgtctccgaggatacaaaagaccttgccgccgaggtgaaaaaacagctgaatgatgctgacattgtgcaggaaaatcagctcatctctttcttacaggatgcgaatgcggccatctattccgggtttattgacttcaccggctgcggctcccgacaaaagcggcaggacatcagctgggtggcatcgctgcagcagctgattgaatacggccgcggaaaagaaaacatgaaaatgctttatcttacaaaaggccttgaatccttcaaaaataatgcggccgctatgcatggtattgaaaaagcggggctttatcgcatgctgcggcatgaatacagccatattctcacctgtcacgccgatattgatcctgaagagccgctggagcagacagccgcttttattaaacaagaaattgaatcagacttaacggaatctgctgtttgctacagggacggcatgcgcttcagctatgttcttcggcagactgatcagattgaaccagaagccgtgcaaacagaccggactgtgtttccaaaagacgccgtcctcatgataaccggaggaacgcgcggactcggcgctttatgcgccaagcatttcgtttccgcatacggtgtgaagaaactgcttctgacaggcagaaaggagctgccgccgaaaacagagtgggatcttgagcaaacagaccctgtcgtttcggaaaaaatacagcttatccgaaagctggaatcacagggcgtaaaagtgtgcgtctcagcagttgatctgacggataagcaggccgtcggacggcttataaaagaggtaaccacaacgctcggacctgtcggaggcattctgcattgcgcaggaattgcggaccgtgaaaaccctgcttttctccgcaaatccaaagacagtatcgcgcgggtgctcgcaccgaaagcagacggcctccgcggtctgtatgagagtgtaaaggatgatgcgccggcatttttcgtcctgttttcatctgtctcggcagccgtcccgattcttgcggcgggacagagcgattatgcgatggctaattcttatatggactattttgcagaaaacaatgagggcggcatcatgagcatacaatggccggcatgggatgagacgggcatgagcagggatacaaaaagcgggatgtatcagcaaacgggattgctgcgtcactctgacgcggaaggtctcaagatgcttgattacattttaagagaaagacccggaactgtcgtgctgccggcacaagtgaaaaatgattgggacatcaaagcgcttgaaaacgccaagccagccgcccataaaggaatgagaacagcttccaaacctcctgaaacaaaaaaacgggtccataaccggactgatattcaatcttggctgaagtcgcttttggcaaaagagctgagtatcgatgaaacgcatatggatatcgatgtgccttttcaggaatacggaatggattctatctttctggcgcaagtgctgacaaagatcgatcaaaaactgccgtccgtttcaattgatccgactgtccttctggaacaccctaccatagaacagctcgcggattatttagccgcacattgtccggaagctttttcggcagatgcagcggttcccgcggagaaggtccctttgcagaaaacgccgaaacagagcaaaaaaacggcagataagcccgggaaacggggaaaggttgcgatcatcggcatggcctgtcattttccggaagcgggggatataaaagaattttggaagaatctccgcagcggaacggatgccgtcactgaagttccgccggacagatggaacgccggggaacactatcagccgggtgaatatcaagaaggaaaaagcatcagtaaatggggcggttttattcatgatattgatcaatttgacccggagtattttaatatttcagaaacgctggcaccgatgatagacccgctgcaaaggcagtggctcgaagtgagcgcggaagctttggccgatgccggttatcaaaaagaggatctctggggccgccgtatcggcgtttttgccggtgcaagggcaggtgcgtttcatcagaaatttcaatatttgcaaaaagacgcgattattggcgcggggcaaaattttattaccgcacatatggcgcacatttataactttacagggcccaacctggtcgtagatacggcctgctccagttcgcttacggcaattcatttggccgtgcaggctattcaaaatggagaagcggaggcggcctttgcgggcggggttgacattttgcttgatgaaaaaccttttctcacaatgagcgcggcgagaatcttatcgccaaatggccgttcaaaatctttcgatgccgatgcggacggaacaggaatcggagagggctgcggtgtgctgatgctgaagccgctcgaaaaagcgatagaagacgaagataaaatatacggcgttattgacggctctgcgataaataatgacggcagcacaatgggggtgactacgccgaatccccgggcgcagcaggacttgattgagcaggcggttcaatcagcggaaatcgagccggacaccatgacatacgtagagacgcacggaaccggtactttgatcggcgacccgattgaattaaaaggattaaccaatgtcttgtctgcttattccgatgaaaaacaattttgcggtgtagggagcgtcaaaagcaatatcggccacttgctgagtgcggcgggcgcggcgggaatcatcaaagttttgctggcgattgccaatgaagaactgccgccgactttgcattgccataaaccgaacccccgctttcaatttcatgattcgccgctttatcctgtgcttgagctgaagcggtgggacggaaaaaaagagatactcagggccggggtcagcgcgttcggtttgggcgggaataacgcccatatcattgtcagcaacgaaggaattccgaaagaacgaaaagcgaccatggaaccgaaaggcggccagacagtataccgaaaacagcggtattggcctgaaaaagcacagttgtccgaagcggaagaaaatgaggcgggcacagaagcaatgtttgaaataagcgaggtgtgatagattggcagttgccaccgatcaagtcaaaacgttcctgcagaaaatcagccatacgaattatatcgtccgggatcatcgcgttcaccaaatccgcgtcctcccgggcgtgactttaatagatatgctgtatcggctcgccgccgggtatctcggtgaaaggcctatagaattaagacagattatttttaagcagcctgttgtaacatctgaagagtttgataaacacctgtatgtcacctttacgccggcgcgtgacagctggaaagttgagattacaagcgaaaaagcaaaaaacggcacaccgcttggcggaaaacgggatgagaatatggaatgtcagctttatttgcaaaaagacacgccccgggcaaaagagctgaatattgaagcattcatgaaaaacgcaagccgaaaatgggacatgcatgacatttacggaattgcaagaagaagccatattgagcatggcgagtttatgaaaaatgaaggggccgtttatcagcttcaggataaagaagaattaatggagctcactctgagtgatttggctgaaggattccgggagaaattcaaggcgcatccggcttttttagatgcgtccacccttgccggctcttcctttgcattgtcggcccaaaagcagaatgacacaccgtatattccttttatgattaatcgtttttgcatatatcagccgtttccgaaaacgatttacacttattctgcggaaaacagccgcactgaaagcggcgcatcagatagcgaacctgatttttattcggccgacttcacgatttacgacagggaagggaacgtattggccgaatgtgagaaactgacagtaaaaagggtcagacaagcgaatatgattacccatctgatagacaaagagaagccgcctcagcagaacaaaaacggccgtggagagcccgaaagtcctgtggccgcagaagacgtgtctgaacagcaaacgccggaacaaaacatggtgacttacataaagtcggaaatcgccaggctgatcaatcgtccggcacaggatattgatgtgcggaaaggcttttatgatatggggcttgactcggcgcatttgctgaagcttgtaaagatattagagcagacttttcagcagcagttttatccgacactgctttttgaatattcatctgtccgccgccttgcggattaccttatcaatgaagcgggctgtgtgctgaaagattcggccgaagaacggcatacatcagacgctgacatcgctgatgaggttctgttttttgaacccgcctggaaagatcatccgctggaaacggcggtgcagaacgggcaaaaacacacccgtcatcttattattgctgccgatgcaggaccccgtctcaccggtgaactcggcacacattgcccggaagcggaagtgatagaactgaaaagggagcatgaggttgcagatgagcagtttggagcagatgccgagcttatatttcgtatgcttaaacgggaactgacagaccatccgaaagaacatacattgattcagcttgtatgcgccgttgagaatggagcggcattgtcttccgctctcggggctatgctgaaaacggcacatctggaaaatccggctcttcgcactcaggtgatcaccttctgtgacaagaatgagagattgccaagtgagacggccgcaatcattagaacagaagcagactgctctcatgcaggctgcacagacattcggtataaagacgatatgcggcagatcagattgttcgaacgtattgagaaaccgggcggacagacacagtctccttggaaacaaaacggcgtatatgtcattacaggaggtctcggcggtcttggatttctgcttgcccgtcaccttgcagaaaaagaaaaggtgaagctcgcactcatcgggcgttcgccggaacagtctgagaagatcagcagactgaaagcattgggagcggaagttctttacgttcaagcggacatcggcagcaaagccgaaacagagcgggcatttgctcagattacagaaactttcggccgtctgacgggcatttttcattgcgccggtgttttaaaagatcaatttatcatccaaaaagacagtactgacttgaagagggtgttcctgccgaaaatcagcggcctgattcatgcggacgaagcttcacggcatgaaccgcttgaatttttcgccgcattttcctcattctcggcgttgaccggaaatgcgggccagacagattatgccgcagcgaacgcttttatggatgaatatatgaaatatcgcgattgcaaagcggaaaaaggcgaacggaccggggcttctatgacgatcaactggccgctttgggaagatggcggcatgcaggttgacagtttgatgaaagagatcatgaatgatgcaaccggcaccagcccgcttccggccggggaagggatggcttcactagaatatatgctgcgtctcggcaagctgcaatccgttattttatacgggaaggagcctgctgtaactgaaagcatggcccgattggttccgatggcagacaagaaccgctcttcattatcccatgcagctgtcaagagaaggagccgaaaacaagagagacatacagaagagcacgatattgccgtaatcggattggcgggaagatatccgcaggcgggaagcatcgatgaattttaccaaaatctgcgctcaggtaaagactgtatcacaacaatgccgaaagacagatggaaaggttatcctttctcatatgaagcagatcagttctactgttacggaggatttttagatcgcatagacagctttgatccgctgtttttcaatctgactccgcgccaggctgaaatgatggacccgcaggcgcggctgtttttagagacggcttgggaagcttgtgaagatgccggtttttatcaggacagaacggcgcgcgggccatcttcacaaaaaagaaaacgcgtcggggtattcgcaggtgtgttttggagccattatgagctgttcggcgctgaaatcacacagcggggcacaccgctgtctatgggcgtgacgcctgcctccgttccgaatatcgtgtctcactgcctgaactttacagggccgtcaatggctgttgatacgatgtgctcttcttcgctcacatccatacatttggcatgtgaaagcattaaaaggggggagtgcgaattcgccattgccggcggtgttaatgcggtcacacatccgcataaatatgcgtttttggcgaatgccggatttctgtcttcagaaggcgtctgcaaaagcttcgccgacggcggtgacggctatgtgccgggagaaggcgtcggcgcggtgttgctgacaaccgttcaagaagcggaaaagatgggctgtccgatatatggcgtcataaaaggctccgctttaaaccatgtcggaaaaacatccggtttgaccgtgcctgatccggcatcacaggcggaagtcattacagattcctttcagagtgccggcattgatccggagacattgagctatattgaagctcacggaacgggtacgtctctgggtgatccgattgaaattgaagggctgagccgcgctttccgcaaatggacaaacaaaaagcggttttgcgccatcggctctgccaaatcaaatatcggccatttagaaggagccgccggaatcgccggattaacaaaggtgcttttgcagctgaagcatggagaaatctttccgtcattgcacgcggacacgctgaatccccatattccatttccggatacgccgttttatgtggcggaccggctggaagaatgggaacggccgtcacatcctgaccagccgagaagagcgggtttaagttcttttggcgccagcgggagcaatgcccattttgtcatagaagaatatctgccgccgcaggctgaaaagaaatcgctgagtatacgggaagacgagccggttctgtttctgctttcggcaaaaaatgaagaacggctattggaatatgtcaaacggtatgaccgctttttacgggaaaaagaagtcaatcttaaagacctggcctacacgcttcaagcgggcagagaagcgatgcctgaacggctggcattgatcgttacatccgtttgcggcctgcaagcgaaactgaaggatgtgcttgaacggaaaacggaaattgaagggtgtttccgcggacgtgctcaagatgttatttcaacaagtggaatggccgagcttttgaaaaacaagcaatattccagattgctcacggagtgggcaaaaggagccgccgttgactggagccagttatacgaaggagagaagccgaaacgggtcagccttcctgtatatccgttcgcgaaggagcggtattgggtgcctgtgcctgcggatatccggaaacagacagacgaaccggcggaaaaccaaaagatcattcttcaaaaagactggaagcagcaagatccggcggagtctgaagcattatcaggaacagtaatgatacttgcaactgataagacgagccgattggccgatgctctatttaaaggaaacggccatattgaaacgatctgtttcatccatcaggcaaaagacggcgccgattattacgctgccgcatcggggcgaaacctttacggcagagtgcgggagtctcttcaaaacaaacagatactcggggtcgtcgacataaccgcatatgatgcggaatatgaacggcgggaagagatagaatacggaaagcttgcctttttacagcaggttctggaatcattccgtcatagcggcgctgtgctcagccaagtgacacaccgcctccagcctttcaaggaaagtaaacctctgatgcagggggcgaaaacggcggggctgtaccggatgctgggcgctgagtatgccaacattcattcttttacgatagatagcgattgtgcgattgagcatacagaagaattaagcagacagattgaaactgaatttttacagccgcgggccaaaagcggcagtgaatgctgctacaggctgaatcgccgttatgtgccgtttctgaagccgggtacgaatgtgtctgcggtgcctgagctttcctattcgtctgatgatgtgctgttaataacgggcggatcgcgcgggatcggcgcaattgcggcggagcatgccgtttcacgcgggtgcagaaaactggtcatcatggggcgggagccgcttcccgattcctcggagtgggaagacatgaaaaaggacggcattctcccggaaaaagccgagcggatgcagaggttagccgagcggggcgcggagatccgttattacagcgtttctcttacggatcaaaaggggctccggaacatgacggacagcatccgcggcacaatgggaccgattaccggtgtttttcattgcgcgggtgcaatgggagaacaccccgctttttataacaaaaccgaaactgagatcgaaagcgtttgcacgccgaaagtaacagggcttggcggtctctatgaagccgttcggaatgagccgctgtcgttttttattttgttctcatccgtttcgggtctgatcccttcgcttgctgcggggcaaagtgactacgcgatggctaattcatttatggactcttttgcaaatcatcaggcaggcaaaggaaacgtgtttgttaaagccgttcaatggcccgtctggaaagaaaccggcatggctgaaggcctgccggaaacacctgcttatcaaaaatcaggactttccaggctgtctgccgaagacggactgaagtttttagattacatcatattaaacggacaaagctgcggaattccttgtgttcccgaagacagtaaggctgattttggtgatcttctgaaggtgaagaaaactgaagctcccatgaaaaaaagcagtgccggtgaccaaaaggtgaaggatatgattcgtcaatgggtgcgcaccgttttcagcgaagaactgaaaatgacggatgagcagataaaagatgatatgccgtttgatgaatacgggattgactcaatactctttgcggaattggttcaatcattgcaaaaacggatcagcatcaagttaacaccgtccttaatgcttcaatatcaaacgattacagaaatggttgactatttcgcagcgcatcatgaagccgattttgtgacaaaagaaaatggtttcgttcaagacggggacgttcagcctgatgtaaccgccgccgctgaagagagaacatccatgaagccgaaagcggataccgaagacgatattgccgtcgtcggcatctcctgccgttttccgggggcgggcggaacggatgctttttgggagctgctgatgaaagggaatactgccatccggcctgtccccgcatcgcgctggcatgcaacagcaaatgcaaaggattatgcggggtggattgatgatatcgacatgtttgatgcgggctttttcggcatctctgaaaaagacgcggcaattatggacccgcaggcgcggatcatattagaagaagcggttcattccgtttatgatgccgggtacggccaaaaggatttgtcgggccggaaagtcggcgtgtacatcggcggcagggcgcagccttcagccggtatggaacatatcctgcaggcgcctaacccgattttgggggcggggcaaaactatttggcggccaacatttcacgatttttgaatgtcacagggccgagccttgtcgtggatacagcatgttcctcagggctgatcgggctgtcctttgcaaaagacgcccttttggccggaaggattgacgcggccttagtcggttcggtgagtctgctcttatctccgtccgcgcaccggttattcggagcgcgccatattttaaatgagaacggcgtgtttcatatattcgaccgtgaatcagcgggagaagtgctcggagaaggagcgggggcggtttttatcaagcgattgagcgatgcggtgcgggacggagaccgcatttacggcgtcataaaagccgtctcggtaaacaatgacggccggacgctcggtcccggttcaccgaatataagagcgcagagagatgtcattcaaactgcgcttaatatggcggaaaagtcgcctgaagacatcggatatatagaagtgaacggaggcggttccccaatcgttgattcggtggaaatcaaggcgctctcagatgtctatcagctgaaccggaaaacgcttctgccctgccggatcggatcggtgaaaccgaatgtagggcatttgcttctgtcttcaggtcttgcgggcttcatccgatgtgtgctgagcgtctatcataagcggattccgcctttcttatcagcgcgtgacccatttgaacattatgactttgaagcgtcgcgtattcattttaatcgtgaacccgttgattggcattcagagaagaaaccccgcgtcgcagctcagagttcatttcctgacggcgggacaaatgctcatatcctcgttgaagaatacagaggtgaaagacagcgggaacatcaccggtcgcctcagccgccggaattcagaaaaaaacactacccgctcttgggcggctggaacagcacggaaagtgaaccggaaaaaacaagtaatgaaaaaacggacattgcggatcttttaaagaaatatgagaaaaaagcagagacaagcactgcacctgcagactcgttttggcaggtgacaacgtgacgtttttaaaaggggactaaccatgaaaaaaacagtgaatctgcgcctgacggcagagcatcccattatgaaaaaccatcttgttcacggagaatctgtcatgcccggtctggcctatattgatatgctgtatcagctggcaaagcaaagccttgatctttcattccgttccatctgtctgaaacgggtgaccatttatcatcctttatcagtgaagcggtcagagcggcttgatgtgagtgtcatattcagtaaagaaaaggagttctggactgcctcgatttgcgaggcggattccgggacggttttcttatcagcggagatgcatgaagaagtcttctcatcagacaggcgtcttgacgcaggggagaaaaaacaacaagccgcacttccatcagtctccttgcatgcggtttacgaagccgcgagaagccgcggactgtcgcatgacgggctgatgaagccggagggagagatctatgcttatgaagaggcatgtttccttgatattcggcagtctgattcatgccgggaaaatctccccggcgctctctttcatcccgcgctgatggacggtgccgccatggcctccggcgtattgcagacagctgcaggcgccgagttatttttaccgatttattatgagtcgtttattgccgctgagactgttacggagcgctgttacgcggtgatttcgaaaaagtccggcacgccttctgaaatggtgaaaatggatattgacttttacaacctcagcggtgcgcatattgcttcactgctcggcctgacagccaaaaaggtgcggtttgaccggcagctgataccaggcgttcagcagatggaggaaaccttataccgcattttctcgacatacgtaggccgttcagtcacaagaaatgatgcgcacaccgtgttttttgaattaggtcttgaatcgtcacagcttctggctattattaaagacatcgaaggggcgtttgatctgcgtctgaatccgactcttttatttgagtgcagcagcatatccgaactgctcgaagacataaaaacaaaaggaacagatgaatcttccagccttgtcgcagatgcagcaccggtctctgaaacacaatcaggcagtcagacatttactttctatgaacatgaagcattccttcaggatcatctggttttcggcaaaccggcactgatgggtgtagtgtatccgtgtctggtgcttgaagcatccggagcgtctcattccggcacgtgtcccgccgagctgaaagatatccgctttacgggcgggcccgtcacgctggagcctggagaggccgcgcagattgacatttcatttgcggcagaaaagagtgccgaacgctttacagcaagctgcactgtctccggtaaagaaagccggaagacatgtgcggaaggagaaataagcagatatacagaggcacccataaaaaaatcatatgacgttgagcaaatgaagtcgcatgcacaaaaggtggcgccggatgtcatttcccgtctgtacgattcggttgccgacttcacgataggcccgatgctgaaaacggtaacagcgggatacaaaatgagtgagagctcctttttattgcagctggacttatcaggaaaaaaagaaaaaggcgatctgcatcactttgcatttgacccgcttatattgaattcatgttatatgtcgctcggtgaagaagaattgcagctgaaaaagcggattcacgtcccgctcatgattgagaggctgacgctttacggacctgtcatgtctgataccgtctatgtggtgaatacaatcaaacataaaaaagacgggtttctctcatttgatgccgcaatcctcagtcataccggggaacagctggcggaattgaaaaatgcgtctgtgaaagaagtgcttcagccaaatcggcttgaaaatgcgtcttttgccccgtccgggaatcaaagccgtcaggaaacgaaaggaaaaccgctggatattgccattgtcgggatttccggcaagtatccgcaggccgatgatatcgatgcgttttgggataatctcaaacaaggcaaggattgtattaccgaaattccgaaagatcgctggaaatgggaacattacttttccgaggaccgtacggcgccgggagcgatctacagcaaatggggcgggttcattgacgggatcgccgattttgatcctgagttttttaagatttcccccgggaagcggaacaccttgatccccaggagcggctgtttttaatgcatgcttggatggccatggaggatgcgggatatacgaggacatcacctgaactggggcgtcaggtaggcgtgtatgccggtgtcatgtatcaggaatacccgctattcgcggctgaagcgggagtgaaaggacggcatatcgggctccccggcgggatttcatccattgctaaccgtgtctcctatttttgtgactttcaagggccgagcatttcggtcgatacgatgtgttcgggttcgctgacttcattgtacatggcgtgccgggatctgcgggatcatcggattcgcgcggcgcttgccggcggagtgaatctcaccgttcatcctaacaagtacttcatgctgagccaggggcagttcatctcatctaaaggacactgcgggagtttcggcgccggaggtgacggctatattccggcagaaggggtcggggtgctgcttcttaaacgtttagaagacgccgtacaagacggagatcggatttacggcgtcattaaaggagctgccattaatcacggcgggagagcgagcggttacaccgtcccgaaccccaaggcgcaaagcgaagtcatttctcaagctttacaggaagcgggggtatctccgggccggatcagctatgtggaagcgcacgggacagggacgaaattaggcgatccgattgaaatccgggctttaaccgatgcattcggtgatgttcctgaaacatgtcttgtcgggtctgtcaaatcaaatatcggacatggggaatcggcagcaggcatcgccgcagttacaaaagtgctgctgcagatgaagcacaaacaaatcgccccatccttgcatgctgatgttttaaatccgaatattcaatttgatgaagggccgttttccgtctgccgtgaattaacagattggaaacggatttcagcagacggagaagaacagccgctcagggcgggaatcagcagctttggtgcgggcggttctaacgcgcatatcattattgaagaatatgaggctcctgtcaaacaagcaatcagcagccaagagccggcggtcattctgctgtctgcgaaaaatggcgagcgtctgacagaatatgcggagcgccttcttgcttttcttcaaaagaagcatattgataagccggacttatttgatgtcgcgtacactttacaagcggggcgcgaagcgatggatgagcggctggctctcattgcggactcccttaaggagctggaggacaagctcagatcgtacttggaaaatgaaaacgcaccgcatctttacaggggacgggcgaagcgaaatcatgagacagtggctgtgtttgaatctgatgaagatttgcaggaagcgatggttaaatggctgaaaaagagaaagtacggtcatttgctgaaaatgtgggtgcagggagtcgatgtggactggaacttgttatattcggaacaaaaaccccggagaatcagtcttcccgtctatccgtttgcaaaagtcagatgctggattcaagatgaagccgaggcggtttcaaaaagggatgacggcaaaacggtgatccatccgctgctccatgaaaacacatccgatctttgggagctgaaattcacctctgtttttaccggacgggaattctttttcactgatcacacagttaatggacagaaggtgctcccgggagccgccgtgatcgaaatggccagagcggccgttgagcgtgccgcatacgctgtgccggacggacgtaaaggaatgtatttgaaagatctcatatggatgaggcctgtcattcataaagggacggatgtagaagtccatatcagccttattcttaaggaaaatgaagacattgaatttacgatttacagcctatcggaagaacctggggagaacggattttatacagtaaaggcactgcggtatcgggagagatagcagcggttccgtctgttcatttagagggctggctgtccggctgcagtcaatcggttatgacgtctgatgaggtttatcaggctttccggcatgcgggtatgatctacgggccgagccatcaaggcattgatcagctgatgatcggagagaggggggctgcagcccggctgtcgctgccggaaacggcagacagtaccgccgatcagtttgtcatccatccgagtcttctggatgccgcgtttcaggcgtcactgggggccggttcagatactgccggagacactccgatgctgccgttttccctgcggcaggcagaaatatttcagccgactcagaaaacgatgtgggcgcttgtccgcaaacagagcgatcggtcagataacggagcgctgacgctggatattgatttatgtgatgaaaacggcgctgtttgtatgagattgacgggcttctcctgccgggctgtccggcagacaaaccaaaccgaaagcaaacggcaggaagttcagacggcgatgcttgcccctgtttgggacaaaactttcttttccctggaagaaaatcgagcggttgatcaggaacaattgctgatcatcggaaagccgggaaataccataaaggccgcggcaaaaatgtggccccgcgcccatctggcggagacgccggatcattcaagcgagcaaacattacgtgaattgacagccggttatcaagatatccgccatttcttatggattgcgccggatcgtttcgcacccgcatccgccagtcaggaaatgcttgatgagcaggagaatggggtgattcaatgtttccgtttcatcaaagcgctgctgtcactcgggtatggaaaccgaaacatcagctttacggcggtcacccggcagacacagtccgtgtatccgggtgatctcccgcagcctgagcatgcaggcgtacacggtttgatcggttcattggcaaaagaatatccgaactgggacatcaggctgattgatgcagaagaaggcagtgattcgtctgagatgaaaaacatctggcgccttcctccagatccggacggaaatgctgccgcgtaccgtaacggagcttggcacaagcaaaaaacagtccgggtgctgacaagttccgctccgcgtatgtcgtacagagaaggcggcgtttatgctgtcatcggcggagcgggcggcatcggagaagcatggagcaaatacatgatcacccgttacaaagcacggatgatatggatcggcaggcggccgaaggatcaggagattcagagcaaaatagacaggctggccctatcaggccccgcgccgcattatatacaggctgatgctcaagatgccgcagcgcttaaagcggccgtccgttccataagagagcgatacggcaatataacgggagtcatccattccgcgataacgcttgccgacaaaagtatggcgaatatggatgaagcttctttcagaaacgctttttcagctaaggtgaatacgagcgtccgaatgatcgaagcttttaagggagaaccgcttgattttgtgctgtttttctcatccgttaattctttcacaaaaaatgccgggcaaagcaactatgcggcagggtgtacatttcaagacgcctttgcccgccatatcgcttccttgcttgattgtgaagtgaaagtcatgaattggggatattggggcagtctgggcgttgtatcagacccgtcttacagaaaacggatggaggcgtcagggatcggttctattgaacccgatgaagcaatggaggcgctggaagtcttactatcagaaccgttcagccaagcggcattcatcaaagctgctccgcacggcttagccgcactgacggatcaagatgcaatatcggttgtatccggcccggagccttcatttatggaaagcgtcaagcggcaaaatccggatcggaatgaacggcttgagactttaaaacgagaaatggagttgcgcatatgaacagccttctttgcaaactgctcttttatcaattacagtcaatcgggtttttcagcgagcctgtcaccacacctgcagcatccatgcggagcgccggcgtgatcggcacatacggcagatggctggaagaaagcctgaatctattaaaagaaaacggatatatcgcgtatgacggatacacgatcactcttctcgcggatcagcgcccggacggccgcacagtctggaatgagtggaatgcccataaacgcctgcttcccaagggggagcttgcgcaagctgaattggccgaggcgacgataaaagcgatgccttcaattttaaaaggagaacgtccggctacggatatcgtatttcccgattcatcaatgcggctcgttgaaggtgtttataagcataatcccgttgcggattattttaatgaagtgttagcagattccgcggccgcttacctgaaagcctaccttacagaacatcccgatgcccgtatcaggctgatagaagtaggggccgggacgggcggaacgagcgccatgctgtttacaaaactgaaaccatttgcaaaacagattgcggaatattgttatacggatgtttctaaagcttttttaatgcatgccgaacaggaatacggacctgatgtgccgtatttgacaacagccttgtttaatgcggaggagccttgcgaatcacaaaatatcaaaacgggtgtttacgatattgtcatcgccgccaatgtgcttcacgccacaaaaaatatcggtttgacactgcgccgtctgaaagcgctcctgaaatacaacgggatgattttgataaacgaaatcagcgatcgttctgtttttacccatttaaccttcgggctgcttgacggctggtggtcctatgaggatgctgagcttcggattccgggaagtcccggcctatatccaaaatcgtgggagcgtgtgctgcattcggaaggatacagagcggtttgtttccctgctgaaacggctcatgatttaggtcagcagattatcgcagctgagagtgacggactcgtccggatgcaagggatcagagacggcagaaagccatacgccgccccggccgaagttttccgaaagcccgcacagcctgtttcccgcagccgcgcgccagaggagcatcaagctgttaaggctgatggggaatcggtcgcttcccatgtccgctctgtcatcaaaacaagtattgccgatgtattaaaaatgaaagaagaggatattcaggaagaactgaatttctctgaatacggtattgattccattttggccgtcaatgtgattaacgagattaataagcgattgaatcttacactgcagacaacgattttatttgattactatcatgtgaaactgctgaccggttatatctcggcagaatatgaaaccatcatagcctcatctctggagaccgaaagagcgaaaatccgcccggtgcttcaggaagaacggcctgctgaaaaacctttgaagacggatagaaaggaaaacggttatcagaaaccgaaacaagaacggatgccgctttctttcgcaaagtccgatgactcgggaatgttccgggttgtgattgaccgtccgggcggcattgaagatctgacgattgcccgcagtgaagtgcccgagacaaaagatgacgaagttcaaatagccgtccgcgccttttctttgaacttcggagacttgctttgtgtcagagggctgtatccgacgatgccgccttatccgttcactccgggattcgaagcaagcggcgtcgtgatcaagacagggaggcatgtaacatccgtcattccgggtgatgaagtgattgtcggtatgggagaggaatttggctctcaggcgaatctcatcacatgtaaagaacatcaagtctatcataaaccggcccggctgacctttgaagaagcatgcgctcttcctaccgtggcagtgacaatgatagacgccttccggaaagccggacttaaaaaaggcgaaaaaatattaattcagaccgcgacgggaggaacggggctgatcgcggtgcaaatggcccggcatatcggcgcggaaatatatgcaacggccggatcacagaaaaaaattgagtatctgcattcgctcgggatcaacaataccatttgctatttggaagaagattttgaaacggaaatcatgcgaatgaccggcggccgtggggtggatgttgtcattaataccctggccggtgatgccatgcaaaaaggaatgaattgcctggcgccgggcggaagatatatcgaaattgccatgactgcgctgaaatccgctaaatcagtcgacttgtccgtccttcataacaatcaatcgtttcacagcgtggatttgcggaagctgtctcttcaaaatccggatcaggtcaaggactatcaattggaactgcagcggctggcggaagagggagtcattcagcctgtcatctcaaaaatcttttcctttgaagacataaaagaagcgtatcactgtctggatgaccgcggaaatatcgggaaaatcgtcatcagcgtttctgagccgtatcaaatgacgtaccgccccgaacaaaaggatccggccgaaacggtaaaatcagcagctgtgttacctgaaaaagaaccgatcgcgattatcgggatgagcgggcggtttgctgaatcggagaatgtccatgagttttgggaaaacttagccgccggacgggatctgattaaaaaagcagacagatgggctgtctctgacagtcaatgccagtatggcagttttatagagggcattgaatgttttgatcccgttttctttcatatatcgggacgtgaagcaacctatatggacccgcagcagaggctgtttctggaagaatcatggaaagcgcttgaagatgcgggatatgcgggagactcggtaagaggccgggaatgcggcgtgtatgccggctcctgcggcggagattaccaggccatttttaaacagcaggggcccgcgcaggctttttggggcaatcacaattccgtcactccggcaaggatcgcctatcaccttaatttacaagggccggcgatcactgttgatacagcatgttccagttcgctgacagccattcatttggcatgtcaggggctctggacgaaagaaaccgaaatggcggtggcgggcggggttttcattcaatccactcccgctttttatcagtcgtcaaataaggcgaatatgctgtcaccgaccgggcgctgccatacgtttgatcaaagcgcggacggcttcgtgccgggtgaaggcgtgggagcggtggtgctgaaacgtcttagcgacgccgtcagtgacggagatcatgtgtacggcgtcataaaaggctctgcaatgaatcaggacggcgctacaaacggaataaccgctccaagcgcgctttctcaagaacgattggaacggcatgtctatgatacttttcacattaatccggaaaccattcaaatggtggaagctcacggaacgggcactgcactgggcgacccgatcgaattcagcgccttaacgcgcgctttccgccgctatacggataaaaaaggatattgcgccatcggctctgtgaaaaccaatctcggacatgccgctgcggccgcggggatggccggattgtttaaaatcctgctgtcgctgaagcatcggcagattccggcttccctgcattttcatcaagccaatcagcatattcaatttgcggacagcccgttttttgtgaatgaaaagctgataccgtgggaacggaatccggatgcaccgcgcagagccgcgatcagttcattcggattcagcggaacaaatgcccatcttgttattgaagaggcgccgcaaaccgtgcgccggtcaccggcaaaaccggcctgcctcattcctttatctgcgcggacggagcgtcagctggaaattcaggcagaacgcctgctggattcactcagcaagaacaaagacagcgatctgggaaatataagttatacgctcctgctcggcagaaagcatctgcatcaccggtttgcctgtatcgtaagcagtgcggacgaactgaagcgggtattatcggagtggcttgtaaaaagagagcttccgggtgtgtttgtgtccaatttgaaggaccagaagccggcagacgaagccggaatgaaaacattcggaatggaatgcattgaacagtgctgctcggcggcttcacccgcacagtacagagaaagcctggcacatatcgctgaccttttttgcagaggatatgatcttcctttcacacggctttttgacggagggcaatattataaaacgccgcttcctgcctatccgtttttaaaagaaaggtattgggcggctgatgtaaacagttctttaccaggccaagccatgaaaaagtctgaaacgcaaaccgttcccccgtctccgccacagcctgaacatgaaggtctgatttctctgagtcctttaactgagatcgaaatgacagcgtttgaaccggagacattgcaaaaaccgatcgtcttacagcctttggattgtactgttcctgtccagcagccggaaaacgccgtttccgaagacaatagaacattgcttgaagaattgaggataagcctggcagatattttatttttgtcgccggaagatattgatgctgatgagcctttcatcgacatggggcttgactccattatcggggttgaatggatacaaacagtaaataaaacgtaccacactgagattactgccaataaggtgtatgaacacccgacgcttgaggagcttgcggaatatatagcggggcaaataaagaaacccgagtatgctgaagcggaggaaacagcggtacgtccgcaaatcccggaagcagaaactccccttgccggcatctctgacggcactttgcgcaaagagcttaaagaaagccttgcggacatcctgtttctgaagccggaagatattgatgagcatgaggcattcattgacatggggctggattctattatcggtgtggaatgggttcagtctattaataaaacgtatcaagcgtctattacggcaaatctggtctatgaatatccgacaatcgcaaaattagccgggtatctgaccggttccgttcaaaaagacactgatgaagtacatgaggaacatacgaaacaaaacgatatatcagaagagacagatgatcaagaaccgcccgaactgatctgtcttaacccggggggaaagggaagaccgattttctggtttcattccgcgctgggggcagtggagctgtaccagcctgttgccgaacggaccgggcgtcctttttacggaattcaggcaagaggatggatgacagaccgggaaccgatccgcggcattaaaaacatggcggaatattacgttaagctcatacgtaccgtgcagccccggggtccttacgatgtaggcggctattcattagggggcatgctcgcttatgaagtcacccggcaattgcagctggctggagaaaccgttgagtcaatcgtcatgctcgactcctttgactcggcgggtgcgcgggaaataaacattcctgatgaattatttgataaaaatatgatgctgcagacggtgaacatggctttatttgcaccgatctatcaacatccggaacgcatttctgaaaccttgattcaccgtgatgaactagatgccgatcttcatgaagacatatttttagagcaattaatagcaaaagccaaacagcgggggttaacgaagacggacgcgttggtgaaaaatctgatcaggcagaatataaacgttcaggacgcttacgaaatcactgattacgaactcctgccgcttccggatccgaacggggtgacatgctattatttccgaaataaaaacggtattttcttgggtgagcttgatccgtattttacgatcagggccgatattttatccgctgatttcgtcaactactggagccagtggcaagagcatatgacaaacatcgccatcatggatgtggcggtatccaaccatatgacgttattggctgaagacagcgcagccgaaacgatttctgaattttgcggcgttttatattcggcagacggaatgacagaacacagctttctgaaactgcaggaaaagatactgaacgtgcatggtgagatgctgaagcagcccgccaaaataagaccgtaaattcacatatccgcccgccgggtttactcgtaagctttggcgggtcatttcaaatcttggacacatcttggaggaatgaaaatgaccagtttaacaaaaatcagacagcagcagccgtacaagtggtaccaaacgatgagagaaacctctcccgttcattacaatgaaaaggaagattgctgggaaatcttcacctatgatgaagtgaagcgggtgatttctgactacagtcatttttcttccgatcataaatacttaagtgcggacaagcaggaaaaaatgatccggcatattaacaaagacagccttttgaaaatggacccgcctgaacacaccgtcttcagaaaattggtcaatcagccgttcatgccgaaatcggttgagtctcttgcaccgcgtatagccgctatcgctgatgacctgcttcaggccgtccgttcaaaaggcaggatggacattattgaagattacgcatttccgcttccgattatcgtgatcgcagagcttttaggatttcctccgaaagacagggatatctttaaaagctgggtcgaccaaagccagaatgtaaaagatgaaaagaaaatgaatgaagtgcaaaagcagatgatcggatactttatgcagtttattttacagcggagaaaacagccgcaaaatgatttaatcagccatttaatttcagctgatttagacggagagccgctgtcagacaagcaattaatcggtttttgcggcttgttgatcgtcgcggggcacgtaacgacggaaaatgtgatcggaaattcatttctcagtctcaaggagttcccgcatattctgccccggctgcttgaaaataaggcgctccttcctgactttattgaggaagtcatccgcctcagaccttccattcagcgggtaacccgctacaccgcggttgagagcgagattggcggaaaaacgattccggccggagaaaaagtatatgcgtggattggatcggcgaacagagatgaaaagaagtttgaaaatgccgatcagattgacttgggacgaaagccgaatcagcacctgtcattcggtcagggcagccattattgcttaggagcgccgctggcccggcttgaagcgaaaatcgcgctttcccacttttttgaacagatgcccgcatggcgttttactgaggatcaagagccgaatctggttccgagccctgtatttcacggcgttgacaggctgcttgttgagttttgaacgaaaaaataaaagaggcttcgcgggaagcctctttactctgggggcttggagaaatgaatgtaggaatcgaagcaatgaacgtgtttggcggaaccgcgtatgtagacgtcatggagcttgcggaacatcggaacctggataaaaaaaggtttgagaacctgctgatgaaagaaaaagtggtggcgcttccgtttgaagatccgattacgttcgccgtaaatgccgcaaaaccgattatcgattctctgtcagaagaggaacggaatcagattgaaatggtcattacctgtacggaatccgggattgattttggcaaatccatcagtacatatgtccatgattatttgcagctgaagcggaattgccggttatttgaggtgaagcaggcttgctattctttaacggccgggtttcaaatgggcgtgaatttcatcttgtcgcaaacatcgccgggagcgaaagcgctcatcatcggaacggatatttcccgctttttagtggctgaaggcggtgacgcgttgacggaggaatggtcctatgccgaaccgagtgcgggggcgggagctgtcgcgcttttagtcagcagcactcctcatgtctttttgcttgatcaaggtgcaagcgggtattacgggtatgaagtcatggatacctgccgcccgattccggatagtgaagcgggggatgctgatctgtcgctcatgtcttatttggattgctgtgaaaattcatttcaggaataccgaaagcgtgtgagcggggcggattataagaatacatttcaatacctttcttttcatactccgtttggcggaatggtaaaaggagcgcatcggacgatgatgagaaaattggcaaaggctaagccgcaggacattgaagcggattttcagcaacgcgtgctgcctgggattcaatactgtcagcgcgtcggcaacatcatgggggccaccgtatttttatctcttgccagcacgattgataacggctcttttgaaacgccgaaacgcgtcggctgtttttcatacggttcgggctgctgctctgaattttacagcggtgtcgttatgccgcaaagccgtgcgcggcagaatcaatttcagatcagccggcatttggatggacgcgtccgtttatcgatgactgattatgaccggctgctccaagacagcggcatcgtaaaattcggcacaagaaatgccgcgcccgcagcagacatcccgaatgcgcatcaaggaaaaacgcgattagtgctgactgaaataaaagagtttcacagaaagtatgaatggacgacctagtataagagccggaaaggcttgagtatttttaaagaaacggagaatacacatgaatccaatgattgatgtacaggaaacagaaccgggcattgtgcaggtcacaatgcaggatacggccgggaaaaacgggctgtcagaagagtttgtaagagagctgcaccgggtattccaagacatcaatgcccatccgtcctataaaactgtccttctgacgggttacggaaattatttctgcacgggaggaacgcaggaggggcttttgaccattcagagcggaaagcttcaatttacagatttaaagcttcacagtcttttattggattgcaggatccctgtgatttccgtcatgcaggggcatgccatcggagctggctttacgatcggtctgagctcggatttcgtcattttaagcagagagagtttttattcttgtaattatatgaagtacggatttacaccgggaatgggcgcgacgtatattgtgcctgaaaaactgggaattgtcctcggggaagaaatgctgtttacggccgcgaatttcagcggcgccgctctggaaaaacggggtgttccgtttgaagtgctgccgaaaaaagacgcccttcaaagaggccgcgaattggcccggctgctggcggataaaccgagagcctcactggttgcgctgaaaaccaatgtgaccgcacggatcaaaagagagctgacaaaagcggttgaggaagaggtaaacatgcacgaagccacattccatcttcctgaagtaaaagagagaatcagccgcttatacggcagttaaacagaatgaaaaaagcatgggatgcccccatgctttatgactggtccgtcttttgcagaacggagcctgcgaattgttctttaatttcggcgctccgggctgcggtttctgcgatgcagtgcatgatggcttcttcaaagcggcgctcgtctaatgcgcgaaggcctgcttcagtcgtgccgcccgggcttgtgatttccttacgcaggcgttcaggccgtttgctgcttgttctgagcatttccgtcgccccggccatggtttgtaaaatcagctcttttgccgtttcttccggcaggccggcttgaagggcggccttttccatcgcttccacataccggtacacataggcgggaccgcttccggcaatggctgtgacggcatcaaggtgtttttcttcaaagagcgtcgcttctccgattgtttccagaagctcttttgccgtccggatttcagcttcactcgcctcggagcttgcggaaaaaccggtcgccgattgctgaatggccgcggatgtattcggcatcgcccggatgatggtgagctttctgccgaaatattgctgaatcgtgtgaatcgtcagccccgcgatgacagaaatcacaagctgatctttcacgtattcgcgaatgttctcaatgctttctgccgcatctttcggtttaaaggcgagaacaataatgtcggtattgctgaaaaactcttctttatcccggcacggtttcactccgtacgttttttggagctcttcaagccggctgtcatttgaccggtttgtcatatatatatgtccgggggctgtcattccgctttgcagcagtccgttcaccattgcttccgccattgatccggccccgataaaaccgattttcttcatataaatcctccttcttctaaaacacaaaaaaaccttcccgtcaaaaaggacgaaaaggtttcgcggtaccaccttacattagcacgaatcagccgtgctcagctcaaatcccgtaacgagggatacgtttaggttttcctaaccgctctgagggcaggttctgtaaacaagagggccgcaatgtctttcagccggggacattgctctctgctgccgttgtttatatactagttcctcgtcatcgcgttccgtgttttctagtttgttgttcattatgctatgcgaaagagcgggatgtcaatctttttttccgatatgcgcaataatgacacagtgaaaagaaaacgctaaaatatgattattcaggaatgaaaagaacgaaggagcgtaaacatggcagcgagaaagatcattccgatacgtgtgccgactccgtttgcagtcggcgacgttatcgtttatttaataaaagatgaagccttaacccttattgactgcggcccgaatacaaaggaagcggctgaatcgctctcatttcagcttaaggaacacggcgtttctgcggcggatatagaacaggtggtgctcactcatcatcacgcagatcattcaggtctgctgcaccttttttccgaggatacggaagtgatcgggcatccgctgaatgacaggtacattactcaggatcagtcgtatatcgcccggcaggaggacttttttctgtcgcttatgactgaaatgggcgttcccctgacgcctgaagacatacagaaaacagttaagctgtcgtacttattttctgcaaaccgtctgttaacgaaaacagtggaagaaggcgggaaaatcgacgggcttaacggctggacggtgctcgaaatcccgggtcatgccgcttctcacattgcgctctaccatgaaaaaagcggtgaaatgttcagcggcgatctgcttttgtccaacagctccaccaatccgattctggaagctccggaaaaggggggcgtgcgcgcggccccgatgctcgactacttgaactcaatgaagcggctgtatgacgtaaacccgtcccttttatatccgggacacggcgatctgctgacggacgtaaagcctgcttttgacaggcggcttgaaaaacagagaaaccggtcggaatatgtgctgcgcctgttgtcagaggaaacgctgacggctttccaggtatgccggcggctgtttccggctgtgtatgaaaatgaattgtttttaatgatgtcagaaacgatcggccatcttgacgtactggctgcaaaaggggaggctgaatcctttcagtcgggaaatactctgatgtttaaagctgtgaaggggtgaaggaaatgggcagattaacggataagcggatttggatcaccggagcatccggcggactcggagaacggcttgcatattcctgcgcggcagaaggggctcatgtttttttatccgccaggcgggaggaccgcttgcaggaagtgaaaaaaacgattaccgcgcgcggcggacagtgtgatgtcattccgtttgacgtccggcatgcagaagaggctgaaaacgtaaggcgtttgatcggtcatgttgacgtattaatcaacaacgccggcttcggtatttttgaaacagccgctgattcatctttggaggatatgaaggcaatgtttgaagtgaacgtcttcggattaatcgcctgtacgaaggcctgtcttccggtgatgcttcatgcgaaaagcggccatattatcaatatcgcctcacaggccggcaaattggcgacgccgaaatcaagcctttattccgctacgaaacacgccgttttagggtattccaatgcgctgcggcttgagctggccggtacgggtgtagccgtgacaacggttaatcccggtccgatcaaaacagacttctttacaattgcagataaagagggcggttatgtgaaaagcgtcggcagatggatgcttgatgccgaccatgtggcagagcgtattacatccgtaattctgacggataaacgggaaatgaatcttccgcgatggatgagcctcgggacgaagctgtatcagcttttcccttcgtttacagaaaaactggccggccgcgcattaaagaaaaagtaacaagggggagaaaggaatgtccgacctggatatacacaaggcattgatgacagagcctttagtcaggcaaatggcagaggcgcgtgaagtattttggatcaacccgcataaaaccgatgatccagtaaagaatggcgctgaatggagaaaggagattgccgaagcggaagaaaggctgcgccggtttgcgccttatatcgcgtcggcttttccggagacggaagcggcgggaggcctcattgagtctccgcttgtcttcatcaatgaaatgaaaaagcgtctggaacaaagcgccgctcaggctttccccgggcgtctgcttttgaaatgcgacaatgaacttccgatttccggttctattaaagcgcgcggcgggatttatgaagtgctgaagcatgctgaagatctcgctttaaaagcgggaatgctctcaacagacgatgattacagcatattgactgaggaacggtttaccgcttttttctcaaaatactctatagccgtcggttctacgggcaatttaggtctgagtatcggcataatcggcgcgaagctcggcttttgtgtgaccgttcatatgtccagtgacgcaaagcagtggaaaaaggagctgctccgggaaaagggggttcgcgtcatcgaatatgaagcagactacagtctggctgtcaaagaggggcgcatgcaggcgaagcaggacccttattgttattttattgatgatgagcattcccgggatctgtttctggggtatgccgttgcgggaagccgtgtgaaaaagcagctcgatcaaatgaacataaagccgggtgcagatgaaccgcttttcgtttatttgccgtgcggggtcggaggaggcccgggcggcgtcgcgcttgcgctaaagctgatctatggcgggcatgtccatatttttttcggtgagccgacgcattcaccctgtatgctgttaggactgttttccggcttgcatgacggaatcagcgtgcaggatatcggccttgataatcaaacagccgccgacggacttgcggtaggaaggccgtccggactggccggccctctgatggagcctgtactcagcggctgttataccgctgatgacggcacgcttttttcactgctttatcaattaagagcggccgagaataagagccttgaaccctctgcactcgccggtatggccggagccgtcaagttcgttcagaccgaagccggtaaccgttatataaaagagcgggggcttgagatggaaaatgccgtgcaccttgtgtggggtaccggcggaagcatggttcccaaggaggaaatggaagagtacagccggatcggttcctcatttgtgaaaaaaatgggcagacagtgaggcggttttccgttacaatctttgtaagcgtttgttttttaatcggaaagccatacagagagattggtgtgaattgtgaaaagtaaagaattgaacttacatacattgtatacgcagcacagccgcgagtcgtgggccggattcggcggccatctttccattgccgtttcggaggaagaagccaaggccgtagaggggctgaatgactacctgtcggtggaagaagtagaaacgatttatattccgcttgtgcgactgctccatcttcatgtcacgtctgccgcaagacggaatcagcatgtcaacgtgtttctgaaacatccgcattcagcgaaaatcccgtttatcatcggaatcgcgggcagcgtcgccgtcggcaaaagcacgacggcgagaattttgcaaaagcttctttcccgtctgccggacaggccgaaggtgagcctggtgacaaccgacggtttcttgtatccgacggcggaattaaaaaagaaaaaccttctgtccagaaagggatttccggaaagttacgacgtgaaagcgctgcttgagtttctgaacgatataaagtcagggaaagagagagtggaggcgcccgtatactcccaccttacctatgacagggaagagggtgccgtcgaggttgtcgaaggtgcggatatcgttattatcgaaggaatcaatgtcctgcagtcgccgaccttagaggacgacagggaagatccgcggatttttgtatcggatttctttgatttttcgatctatgtggatgccgaagaaagccggattttcacgtggtatttggagcgtttccgcctcttaagagaaaccgcttttcaagatccggcttcttattttcataaatttaaggatttgtctgatgcagaagcggataccatggccgcctccatctgggagagcgtcaaccgtccgaatctgtatgaaaatatcctgccgacaaaattcagatcggatttgattttgaggaaaggtgacggccataaagttgaagaggtgctggtaaggcgggtgtgatgtgaggaggaagcgaatattatgatgcatcatattgaattgtatgtatctgacttgaaagcctccgcccggttttggggatggtttttaggtgagctcggttatagggagtttcaaaattgggactccggcatcagctggaaaaacgccggattttatgttgtgcttgtacagacagaggagcgttttttaacaccggagtaccacagatgccgggtcgggctgaaccatctggcttttcatgctgcgtcaagagagcaggttgacgggatgacggaaaagctgcttgccagaggatgccccgtgctttacagggaccgccatccatatgcaggcggaagcacgcattacgccgtatacacggaggacccggatcggataaaggtggagctggctgcgcctgcttctgaatgaactataacttctcgtttttttcttcgcgcagcgcgtcgagtttcttttcgattctgtccaattgtatgcggcgctgcttcaagcttctgaatacgtatatcacggcaaacaggaaaaatgcggctgcaataaatgagatcaattgaaaaatgacatcaccgatgttcatcttttttacctccgtgtgcggcgggcttcttcagcccgccgttttttcattttaaccgatgtgaagacatgggggatgaatcatttctctcctagctttgtttctttctgagaatgaatagtttctgcatatggcttatgatcacttttgcggccgcatatcccggaatggccagcagcatcccggcaattcctgagaatttgccggcggcaagcagaagaaaaataatggtcagcgggtgaatgtccagcttccgtcccataatttgcggggaaatcagctggctttcaagctgctggacaatgacgacgaccgtaatcaccagcaccgcctcggtcggtgaatcgaacaatccgacaatgactccgggaaatgtgccgatccaaggcccgataaacggaatcagatttgtcaccatggcgaacgcgcccagaacgagcggataatcgagcccgatgataaaatagccgattgtgacgagaacgccgacacagaaactgacgagcagctgtccttgtatgtatgaactgagagcttcatccatatcccgcaggatttgttttccttctttttgatgtttttccggaagaagccgcagcagtcgccgggggctttatttccttcttttaacatgtaatacagcgcaaacggaataatggctgcggtgatggcggcattggcagccgtaccggccagactgctgagagaatcagcgattgaaccggaataatttgcggctttgtccgctaattttttaaaggaatccccatgctgaagcctggaaaaccatttgctgtcctgaagatgcccgatccaattttcagcttttgcggaaagctccggaatatggtctgtgaaggctgtaaactgtttttgaacggcagggcccgccgtataaaggaagaggacaaaaaggccggctgttcccgcataaatcgctaaaatcgcgattccttggggcagctttaatttcgcatgcagcactctgacgagcgggcggcacaaatagtaaaggacacccgataatacaatgggcggaaacaaggttttaaccgtaatcacaacaggctggaacaaaaagtctattaatgttccgagataaatgatgagaaataacagaagaacggcatagccgatcttgaaataaggcccgacaggcatatcctgcaccacgcaatctttagggtttactctcggacgtttcccttttcgcccggtgcataaacgtccgtgtcaggaaaactgcccctgattggtgacgtaatcgtagataatatcttctacatgggcatggagatcctcatcgggttcttcattccttctttcttctaaagctttttttaaactctgtttttcataggggctcagcggatctgtcgacacattccgtccatactggcggagggcttgtcccagcattttttctataaattgatccatcatatattctcctattcttgtcattcatctttattctactaaatatcatgtgatcctcccactcttctatcatattttctgtcaggacgatttaggcttttattccagttcagccgagagaataagatgaaacggcagcgttaacgcatcttcatcgtttatgatttttaaacgtttttcgtcatgcctcacttgtttcacccatccccaaaagcggcgggggccgcgtgctgaagcataggtgaccgagatggctctgtcttcttcaatcgacgccgcaatgatgcggttcatgtcgttcagttgctctgcgctcagttccggaggccggaattcccgttcttttcgtttttttgcaagcagctgctcccgatgttcgggcagcatcatccggcttgattcccacatgacattatacccgggtgttaatttgttcggattcatgtatatcacctcaattatttgtaatgcccgccgattttttcagcccggtgaaaggcttggccggcctctgtcagcgaagcggcatggaggagcgacgcagggccgtaccgctcatgaatatcatccaatactttgccgagactgatctttttttcctgagcatcaaacaggctcagctgaacataatcacagggctccagctgggaaagggagacgccggcgctgcggacgggctcaccgttccaatgctctttgaagagcttgaccgccgctttaaaaatatccattccgaaattagtcggagagaccagctttctctgtctgtgaaaacctgaagggaattcaaaatcagcgcctctgatgctgaccgaaaccgtatggccgatgtattgtttgaaacgggcgcggcgggccacttcttcgcttaactccaacagcacgactttgatatcctcaaagcggctgtagtctctcgggagggtcatgttatggccgatcgctttttgccggctgtgcgtgttgacggtgaccggagagggatcgatgccgcgggctgtccgctgaagcaattcgccgttaatgccccagcgttttttcagcagttcggcggggtgcccggcaagcccgccgattgtgctgatgcccatccgtcttaaatgatgctccatccgttttccgatgccgaataattttccgaccggcagcggccacagatcctccctgatatttgacatatccaatctgtggatgccggatgcgttttttttggcaaaatggtcgcaagccattttcgcgagcgccttattcggcccgatgccgacacgggcataaattccgaattcacgcataatcgcttgctgaatgctttcggcaattgtaaaaggatcaccgaacagccgcctgcttccggtcacgtcgagaaactgctcatcgatggagtagggttctacaagatcggtataccgttcaaacagttcggtaatcatgacggatacatcaatatactgctgcatccgcggacggacaataacggcgtcgggacatttggcctgcgcttcccacagccgttcggcattttttacgccgtatcgtttggcgagcggacaagccgcaagcacgacgccgctgcgtctttcgggatctcccgagacaatcacgggccggcttttgagatgaggcgcttccgctttttccacagacgcataaaacgattgcatatcaacaagaagaatatcagccataaaaaaacctccgggaacgtttgttctgtttttcattgtacccgaacaatgatcacgtttatactggtaaatcattccccggctggaagacgtgctgattcgtttgcttgaaaagaaatcatttacaattgcaaacaacccacatataattttttatattccaatgagaagagctgacattcattttgccggacgaaaaggagagtcaatcgataatggatattcgaacaattacctctgaagactatgaaatggttacgtctgttttgaatgaatggtggggcggcaggcagatgaaagacaaactgccgcgcttgttttttgaacattttcaggacacgagctttatcacgtacgggccggagggaatgaccggttttttaatcggttttcagtcacaatcagaccctgagacagcctacattcatttttccggtgtgcatccggatttcagaaaaatgcaaattggaaaacagctctacgatcgatttatggagacggtgaaaaaaaggggctgcacaaaagtcaattgcgtgacggcgcccgtgaataaagtatcaatcgcttatcatacaaaattaggctttgaagttgaaaaaggaaccaaaaccgtaaacggaatccctgtttttgcgaattatgacggtccgggagaagacagaattctgtttgtgaaatatatgtagagggggatgaatatgggttttttagctgacacgcccaaaccgccctattatgcggtcattttttcatcaataaagggaaaatatgatgaggaatatgagcatacggcagagcgcatgatgaatttggcaggcggacagccgggctttttaggcgcggaaagcgttcgggaggaaaacggctgcggcatcacggtttcctactgggacagcctggaggcgattaaaaggtggaaagaccatactgaccaccgggcggcaaaacaaaaaggaaaaagcgcctggtatgaagcgtacgcggtccgcattacgaagacggagtcacagcggatgtttgcgtcaaaaggggcggaagattgattacatttttacggcatacacaagaacagacggcgcgggaaattgcggcggttcaacgctgctcttatcaaaaagaagccgagctgatcggctttttcggcattccagccctgcatgaaacacccggtgacatacagcggtcacgggagacgtttgccggtttcagagaaaaagatcggcttgcaggcgtcatttcgtatgaaaaaaaaggatatgaccttgtcatatgcaggctgacggtgcacccgtccggctttcggaaaggaatcggacgggcgcttattcaatttgtgatcgaccaaaaccgggacgcccaaaaaatagaggcggctaccgccagtcaaaacgttccggcagtctctctctatttaaaaaccggcttcacagaagccggacagacagagacgccggaagggctgaccctctcgttttttcatctttatccgaagaggaaagcggaagttgttccgtacaagccggaatggaaagagatgtttgaaagagagaaggcggacttgatccgaatcttcggccccgcacttcattctgtcagccatatcggcagcacctccatcccgggaatggccgcaaaacccgttatcgatatactggcggaggtcaaagatatttcagatgctgaccgattcagcccgcagctggaagcactcggctatgaggcgcaaggggaaaacgggatagagggccggcgtttctttcaaaaaggcggcagcaagcgcacacaccacgtccacatatacgaaacaggccatccggatgtgaagcgccatctgctgttccgggattacctcactgaaaagcctgaaaaagcggctcaatacatggaactgaaacggcggctcgctaaggcatacccgtacgatacggcaaagtatagtgaagggaaaaatgactggatcaaggcggctgaacaagaggcaaaggactgggagagcgggcttctgtaaagaaagcagaaacaatgcatacagcggctcggtatgctacaatggcgaaaatgaaaaacggaggatcatctatgcaaatacatgtgacggatgcggcgaaacacacacttcagcaggcgatggacgccaacccggggaaaaaagcgcagctccgctatgacgcagaaggctgcgggtgcgcggtgagcggcgtgccgaccatctggctggcggacgaattaacgggacaatgcgaagccattgaaaccaacggacttccgctttacatccagacctcacaaaaagtgttttttgacgaggaaatgacaatcgattacaatgaaaaggcaaaaacgctcgtcttaaaaagcccggcagagatgctgagcccgagaatgagcatattagtaaagcagggagaaacggaaagtgaatcaaaagctgaaagccattaaacagacggcacagcataaaacgtgggtatcctttctgaacaacaaccacccgtacagtctgctgcactggtccatcggaggcgctgaatccgttcagaaggatgtctggctgcttcaggatgagatgaccttcaaagcgcaggagtttacgacaatcgacctcgccattgactggatcggagaaaatatggacgggattaccgacgttttatgacgggaaagcgaaagaaccagcatacgttctttcgcttttttacgtttgcgtcatggtatctaaaaaggtttgaacggctttgcggtagctctccggatttttggtgtacgacatggcatgcccgcccgattcggccagatagagcatcttcggtccgcgttttctgcggtgcagcaattcggaagaagcgggaggtatataatcatcttccttactgtgaataaacagcacgggctgccggtcggctgataaccgatagaggcgatacatcacggatacggtatccttctctcatccgcaaaaagaaatcagccaaaggcagaagcggccacggaggcagccggaactcccgcttcagtctgtaggcgagctgatcgcgaaagcttgcgaacggacagtccgcaatataaaaatcagcgcctttttcatcctgatgcccgcccgcgtataataaggccgtcaccgctcccatcgattccccgtggatgccgatttgaccgccgtctcccgttttgtgtctcacccaattcacggcttcttccaaatcatctttttcaaaatagccgtagctcgtcgttctgccgccgctttttccgtgcccgcggtggtcatatacgagcacattccagcctgaatctaaaaataaatccatgtatttcaatgaattgaacgaatttacggtaacgccgtgacaaataatcatggcgtttgccgtatgatgcggggcgacgtaaaagcctttgatctcatacccgtggcgtgacaggatgacggcctcttctttttccatggcctgaaaggaatcaaatctatcatgcccgtccgccgtttcttttttcatgatatcttcatccgtctttttcttcataaacataatgagattcgtaaaagcgaatccggcagccaaaaagactgcgcaagccgaaccgaacaccgccagccattttttcacacaggggccctcctttcatatgaaaaatccttcctccggcttttcaggaccgtgaacgttgccggcctccggcgctccgtggtacacttgcttcaccatattcagatacggggggcgtaatgatgaaaaagcagctgcctaaagaaaaacacagcttaaaagacgatctggaggaagatctgaaggccaggcttttgcaaatgaaaagtgagctgaaggaagaagacgagaaaaaacaggcgcagcaaaaagcggaacaaatcagaaagcgaaaagaaaaagaaaaacataaaagctttgaagagctgctgaatgaaagcagtctcgattggcacaaatataaataaaccggcatctgacaaggtgccggttttattgtttaagaacgatgggcttcgtatacgtcccgttttgtatggtattgcagggctttgatttcctggctgcttaaacgccgggcctctgcagccgaacagttttctctcagctgctcaagtgagctggctccggtgatgacagaagcgacggccggctgtgacagtaagtattgaagggaaagctccgtcatgctcaagtcaggtgcggcagcgccgatcgcttttttggtttcttccaattctgcaaaagaatatgttaaatacccgttctcttttacgcttgcggctgcttgatcaagcggtttttccgtaagaagccctttagcgacaggccctctggcgactacgctgattccgttctcctctaaaaggggaagccactcctcaggacgccggtccagcaggctgtattgcatcataacgcttgagatatttgattttttcacatattctttaatgacattcggacgaatcgaggaaatgccgtaataccggatgacgccttcctgttttaagtcctcaaacgcttcgatcgtttcgtcaatatgatcttccatcgtgccgccatgcagctgataaaggtcgatatagtccgttttcagccggcgcagactgtttttgaccgcttcttttatgtatcctttggaggcgtcccaatgccagccgtctttatcatcattccagcggtttccggctttcgtggctaaaatgatgtcgtgcctgcggtttttgacggcctccccgacaatttcctcatttctgccgaaatcataaagatcagcggtatctaaataattgattccaagctcgatcgcttcatccaaaatagacagcgcttcagctttatccgtgcccagcgacatacagccgagcccgatttcgcttatttctaaatcagaatgtcccagtgtgcgttttctcatcgtttcgctcctttttatagtcttttattgaccgtaatataaaggcgcgaagttttcaactgttaaggcccggtgatccaatctccgacatagcggaatgtccgtccgtattctttcagtttagcccgcacttcccacgcctttccgaccaatacgatacttttatccttccggtacaccttcaatcgaaaagcacctccctctcatgcatgtatgataaaatatatgaggcataatagagagacagaacgggagatgacatgatgaaacatttagaagaaaaaacacttgcgaaaaaaaagctgtatgacgggaaagtcatagatctttacttagaggatgtagagctcccgaacggaaaaacaagcaagcgggaaatcgtcaaacatccgggagcggtggccgtacttgcggtgaccgaagaaggaaaaatcattttggtaaaccagttcagaaagccgctggaacggacaatcgttgaaattccggccgggaagcttgaaaagggggaagagccggaacatacggcgttaagagagctcgaggaagaaacgggatatacggcggaaaccttgacgaaaatcaccgctttttatacatcacccgggtttgctgatgaaatcgtgcatctctttcttgcggaagggctttcgccgctggaagaaaagcgcgaactggatgaggatgaatttgtcgaagtcatgcaggtcacgcttgaagaggccgtgaagctgattgaatcccgcagggtgtatgacgcaaaaacggcgtacgcgattcagtatctgcagctgaaagaagcactgaaggaaaaatgatgaaaaccatctatgcggatctgcatattcatatcggccgcacctatacgggaaaaccggtcaaaatcaccggggccaaaacgttgacgctgcatcggattttagaagaggccagtgaggggaagggaattgaactattgggcatcatcgactgccattccccggaagtcatagaagaaatcgagcgcggaattgatgaaggcagataccgtgagctgaaagaaggcggcatccggtatcggaatacgacgcttctgttgggcagtgagcttgaaatctatgatcacacatgccgcgggccgattcacgttctcgtctttatgccgtctcttgccgaaatgaagatgttttctgagtggctcgcaaaaaggcttaaaaatatccatctcagttcccagcgtatttatgaaaccggtttgaatcttcaaaggaaaacaaaggaattgggcgggctgtttattcccgcccatatgttcaccccgcataaaagcctgtacggaaaaggggtcatatcttctttgacagaagttttcgacccggcgctcattgatgcggcggaactcggattaagctgcgacaccgacatggcttcgcgggtaacggaacttgatccgtatacatttttaacaaattctgatgcgcattccttaggaaaaatcggcagagaatataatgaaatgcttcttaaagaagcgaatttcacggaattttcgctggctttaaaagggaaggacggaagaaaaatcacggcgaattacgggctgaacccgaagctcgggaagtattaccggacggcttgcgaccgctgcggcagcccggttgaaaaaggagcttccgcctgtccggagtgcggggggaaaactatgacaaaaggggtcagtgaacggctggaggaactgagcggcccgaaaaaaagccgcgtgccgcggccgccgtatattcatcaaatcccgctgcagttcattccgggggtcgggccgaaaacgttagacaaactgaagcgggctttcgggacggagatggcgattcttcatcaggcgcaagaagaggaattggcgcatgtcgtccagcctaaaatagcggctgtcattcataaagcgcgcaccgggcagctcgtccttgaggccggggcggagggacgtacggcagaatcaagtcgtaaaagccggattttagcggagctcctcctgcaccttctttttcgtgcggacaaacgcaatcaattcgatgatttcatcctgattcagcggctgtccgtcaacggtcagtgtgccgcggccttgtgcggcgtttgttaattcgatggtctgggtaaacggctccgcctttttttcagtgcgccccagtaaatcgtcgcacgtcgtgtcaaacagatcggcaagcgtgcccagcgcttcgaatgacggacgccggtatcctgattcatacccggcgtacgtgcttttggcgatgccgagacggtcagccgtatattgaagagaccaatttttcttttttctcagttcagttaaacgatctaaattcatattcaaaaccgctccttttcacttgagcaaattatatcatatcgatatgcaaaagtgtacgcgaattgaataataatcacttgattaatttcaatcgtctgtctataatttgattaaaagtatgcgaaaagcgaatgcttaacacatcttgagaaatggatgaagaggtgcagggtatgaaaaaattattgctgttaacaaccggaggaacaatcgcctcagtcgaaggagaaaacgggcttgcacccggggtgaaagcagacgaattgttaacctacgtatcaaaacttgataacgattacacgatggaaacccattcgttaatgaacatcgacagcacaaatatgcagcctgaatactgggccgaaatcgcaaatgctgtcaaagaaaaatatgacgcatatgacgggttcgtcattacgcacgggacagacacaatggcgtatacatcagcggcactgtcttatatgcttcagcatgctgataaaccgatcgtcattacgggttcgcaaattccgattacatttcaaaaaaccgatgccaaaaaaaatatcacggacgcgatccgcttcgcatgtgaaggggtgggcggcgtatacgtcgtatttgacggcagagtcattcaaggcacacgcgccattaaattaagaacgaaaagctatgatgcatttgagagcattaactatccgtatatcgcgtttattaccgaaaacggaattgaatacaacaaacaagtgcacatgccaaaagacgatgcctttacggtcaatacctcactttgcacggacgtgtgcctgctcaagctccacccggggctgaaaccggaaatgtttgacgcattaaagggcatgtacaaagggatcgtcattgaaagctacggcagcggcggcgtgccgtttgaaggaagagacattctcgccaaagtcaatgaaatgattgaaagcggcattgtcgtcgtcattacgacacaatgtcttgaagaaggagaggacatgagcgtctatgaagtcggccgaagagtcaatcaagatctcattatccgctccagaaatatgaacacggaagccatcgtgccgaaattaatgtgggcgctcggccagtctcacaacttggctgaagtcaaaaacattatggagacaccgatcgcagacgacgttgtactgtaaaaacatgactaccacaaagagaaagtagggttttagcatgacaaacgcgcaaaaagaatatcgtcaggaaaaagatttcctcggagaaaaacaaattgaagctgatgtgtattacggaatacaaacgctgcgcgcgaaagaaaactttccgattaccggctaccgcatccacgaagagatgattaatgcgctcgccatcgtcaaaaaagcggcggcgcttgccaacatggatgtaaaacggctgtatgaaggaatcggaaatgcgattgtccaggccgcagacgagattcttgaggggaaatggcatgaccaattcatcgtcgatccgatccaagggggagccggaacgtccatgaacatgaatgccaacgaagtaatcggcaacagggcccttgaaatcatgggccataaaaaaggtgaatacattcacctcagcccgaacacacacgtcaacatgtcccaatcgacgaacgacgtgttcccgacggcaatccatatttccaccttaaaacttttggataagctccttgatacgatggcgcatatgctgagtgtctttaaggataaagcgaaacaatttgattctgtcattaaaatggggcgcacacaccttcaggacgctgtgccgatccgtctcggacaggaatttgaagcatacagccgcgtgctcgagcgtgacataaagcgaattaaacaatcccgccagcatctgtatgaagtcaacatgggggcaacggccgtagggacggggcttaatgccgatccgcgctacatagaacaggttgtaaagcacctggctgacatcagcggactgccgcttgtcggcgccggccatttggttgacgccacacaaaacactgatgcgtatacggaagtttcagccgcgttgaaagtatgcatgatgaacatgtctaaaatcgccaacgatctgcgcttaatggcttcaggtccgcgcgcgggacttgcggaaatttcactgcccgcccgtcagccgggatcatccattatgcctgggaaagtcaaccctgtaatggcagagctgatcaaccaaatcgccttccaggtcatcgggaatgacaatacgatctgcctcgcttcagaagcgggccagctggagcttaacgtaatggagccggtactcgtatttaacctgcttcaatccatcagcatcatgaataacgggttccgttcatttaccgatcattgtctggcgggaattgaagccaacgaaaaacgtctgaagcaatacgtggaaaaaagcgtcggcgtcattacagcggtcaatccgcacctcggctatgaagcggctgcgcgaattgcccgtgaagccatcatgacggggcaatctgtaagagatctttgccttcaaaatgatgtactgacagaagaagaattggatatcattttgaatccgtatgaaatgacaaaaccggggattgccggaaaagatctattagaaaaataaattttaaagcaacaacagccgccttttcacgtttttcagtgaataggcggttgccatacaaagggatgaggcagtatagtataatttgttatatcatttgatgaaagcgttttagcttttttcttctagggggattttcttgtgaaagaggtcagattgccaaatttattggaaattattatcttattattcgggtttttagcacttgtcttatcgttcacagtgtttttagacctgccgatccagctagctctattaatatcctggtttttcgctattattctcggagtcaggctgggatattcatataaagacttgcaggattcgattgtcaccgggatatcaaacggtcttgaagcggtgttgattctcgtttcggtcggtgcgctcatcgggacatggattgccggcggtgttgtgccgacgttaatttattatggtttagagtttattaatcctcatattttccttctggctacactggttatttgttccgttatgtccgttgcgaccggaacatcgtggggaaccgtgggaaccgcggggatcgccatgattgccatcggagagggaatgggtataccgcttccgatcgtagcgggagccgttttgtccggcgcttacttcggagacaagctttcaccgctgtctgacagtacggtgcttgcctccacgctttctaaggtggatgtgctgtcgcacgtcagagcgatgatgtatctgtcaattccgtcctatattattacggccattctatttaccgtaacgggatttatatacggcggaaaaaatattgatctcgacaaagtggaatttttaaaatcttcattgcagaaaacgtttgatattcatatatggatgctcattccggctgttgtcgtcgttgtccttctgattttgaaaaagccgtctatgcccgttattatcatcggtgctttgcttggcgcaatctgggcttccgtctttcagggaatgaattttgccagtgccatcgcgactgcttataatggtttttctattaaaacggacgtcgaatttttaaacggcctgttaaaccgcggaggcattaccggtatgctggatacgttagtcgttatcctgttcggtctcggttttggaggaattcttgagaagctcggcgtattaaaagtgattgtctcaacttttgagaaaaagctgaccacaccgggaaatgtgacgctttcgacattgatcgtcgcccttttaggaaacattttcggctgtgcgatgtacgtgtcattgatcctgacgccgaaaatcatggagaacagttatgataaactgaaacttgacagaagagttttatcccggaacgcagaggtgggcggaacgcttacttcagggatggtgccgtggtctgataacggcatctatatggccggcattctcggcgtatccacattttcatatctgccgttcatgtggctcagttttgtatctatcggactggcaatattgtacggatacacggggaaattcatttggtacacgaaagaaaaatccttgcaatctcaaaaattgggttaggaggttcatttcatgattacaaagcatatgattcggacgttaatgattgaaacgccgactgttcccggaaatctcggaaaagtggcaaccgccatcggagtgatgggcggagatatcggggaagttgaaaccgttaaagtcggcccgaactacacaatgcgcaacatcacggtgcaggccgaaaatgaggagcagctgcaggaaatcattcaagccattgaagctctcggtgaaggcatccggcttcatacagtctcagatgaagtgctctctgctcatgaaggcggcaaaattcaaatgaaaagcaaaatgccgatccggacattggctgagcttggccgtgtttatacaccgggcgtcgccgatgtgtgccgactgattgaaaacgagcctgaaaaagcgtccatctatacgacaatcagcaattctgtcgccattgtcaccgacggcacggcgattctcggcctcggcaatatcggttctgtcgccggaatgcctgtaatggaagggaaagccgcgctttttgaccagctggcgggtatcagcggaattccgattttgcttgatacctctgatccggaagaaattattcgcacggtaaaacatatttctccggggttcagcggaatactgcttgaagatatcggttcgcctcactgctttgacattgaagaccgcctgaaagaagaactggatattccggttatgcacgatgatcagcacggcacggcggtcgtcacgctcgccgccgccatttccgcttgtaaaagcgccggtcttgatttaaaagaagcgaaggtcggacagatcggtctcggcgcggcaggcgtcgccatctgccggatgtttatggcatacggagtcaaagcggtctgcggaacggacaagtcagaagacgcaatgaaccgcctcgctcagtacggaggtcagccgcttggaagcatcaaagatttaatggacacgtgtgacattgtgatcagcaccaccggagttccgggtctcattaaaaaagaggatgtcagaaaaggacatgtcattctggccttatctaatccgaagccggagattgaaccggaagacgcattacaagccggagccgcttatgcagccgacggccgctcggtcaataatgttctcggcttcccggggattttccgcggcgcgctgaacgccaaaagcaagaaaatcgaccatgaaatgcttgtggcggccgcagaagccatcgcctcttgcacaaaacacggcgatctcgtgcctcagcctttggatgcggacgtgcatcaggctgtatcagcagccgtagaacgggccgcggcaggaaaataaacaactcttacagtaccggacatgtgccggtgctgtttttttagatgaataggaaacggaattcttaggcaggctaacagatagcaaaagacggaataaagaggtgtcaatgtggattattttccgctgatccatacaaatatttgggatgctgtgatcggcgtgccggtcgtcttatgcgttacacagctgatcaaagtgttctgccgggttccgggcatattcgttcccacgattgcccttgctgccggaaatgttgtgtctatcgttttcggtcaccatgaacacgtgtatgcggggattttcatgggatttttttacggatacgccgctatggggagctattcatctgccaaaacgtctctgcgcgcttaccggtcgaaacatgagccgtattcatgaacacatcgggatttttttgttatgataaagaaaaggcaaaaaggagcgattggcacatggcgaagagcaaaacgaaaaaaatgcgggagcatctcagaagaaacgggatgcgtgacgcagtcttgtcaagggggacggcgccgcctttcagcacccatgaaagagtgacgaaaactaaaaaagacaggcttgaaagaataaagcataaaaaaaggaacccctatgatcaccggagtgatgacgggggttctttttttatgcccgaatctcgcgcctttctatgatttctctgtcatgttttctcttttctttcatacaatctactaaatcaagtcaatagattagcgggaggaaagcggtatgagaaaacaatcgtacaaagaactgttttttcgccatgtaaaggatcatctgtcactttatatatttgtgttcgtcttgtttttgatgggggtcattttcggggcgatcatcgtcaacagcatgaccatcacgcagaaagaagatttgtattactatttaagcaagtttttcggacagctgtctgacggaaaacatgccggcgcttcagaaatgttttggcaggccgtctttcatgatgtaaaatatttggggctgatgtggattctcggtatttccgtgatcggtcttccggttattttcattatggtgttcttaaaaggaatcgtcgtcggcttcacggtcggttttttagtgaatcaaatggggatgaacgggtttttcctgtcatttatttcggttctgccgcaaaacatcgttctcattccagcatatcttatcatggggacatgctccatcgctttttcactgaaactgatccggcagctgtttgtcaaacgcagccttcatgacgcgccgatccaatggttcggacgctacgccttcgtactgattctcatcgttttcttctcggtcctcgcttcactgctcgaagcgtacatgtctccgctgtttatggaaaagctgtcatcacgcatattttagaattattatcacaaaataatacttttatttatcagtttataataattatagttggaactctgcgcgtattttgttataatgagtcatggaatgcggcgtaggagggaaagacatggaaaaccgtattgatcgaattaaaaagcagctgcactcgtcaagctacaagcttacgccacagcgggaagcaacggtaagagtgctgcttgaaaacgaagaagaccatttaagcgcagaagatgtatacctcctcgtaaaagagaaatctcctgaaattggtctcgctacagtataccgtacattagaattattaacagaattaaaagtcgttgataaaattaacttcggggacggcgtatcccgctacgaccttcgcaaagagggcgcggctcattttcatcaccatttggtgtgcatggagtgcggagccgtcgatgaaattgaagaagatctgcttgaagacgttgaagaagtgattgaacgtgattggaaatttaaaattaaagatcatagattgacttttcacggaatctgccaccgctgccgcggggatgaaacagagtaaaagcctatgaaccttttctgccaggaaagggttttttgctgtttttatgtataaaagcctttgaaattggcataaggtgtactaacagccgccaaagaaagggtcgatcgaaagatgggcagattcctgaaaacagccgcggatacgatcaaagtgtttattctgttcacaggttttaccgcgctgttctattatgctatgatatgggtgaattcagagtatgaaaactatcatcggtacgataaaccggaaggctccgccgtcaaagtggccaaaacggaacatgaggagaaagacggctggttcggccgattgatctttttttaccaaaacggggagtagatcaagagtgaaggatcaaattaaggatttcatccattatgtgagggttgaaagagggctgtccctaaatacgatgatgtcctatgagcgtgatctgaaaagttattctctcttcttaactgaaacccttcagatcacttcatggaatgatgtgacccgtcttcatattattcaatatttaaagcatataaaggactccgggaaatccggcaagacgtctgccaggcatttggcgtcgatccggtcttttcatcaatttctgttaagggaaaaagccgcggataaagatccttcggtacatattgaaacacaaaaaacagagcggacgcttccgaaagtattggcgcttcacgaagttgagcggttattggacacgcctaagcttgacagcccgttcggtctcagggataaagccatgcttgaactgctgtacgcaaccggcatccgggtcagcgagatgatcgagctgaaattatccgacgtccatttgacgatgggatttgtccgctgcttcggaaaagggcggaaagagcggattgtgccgattggtgaagccgcttcccatgcgatagaagcatacattgaaaaagccagagggaaattattaaagaaaaacgtaaccgaagcgctttttctgaatcatcacggcaggcagatcagccgtcagggattctggaaaaacctgaaaaaaatcgcccttgaagcggggattaaaaaagagctgacaccgcacacgctccggcactcttttgcaacgcacctgctcgaaaacggcgcggatctgcgcgccgtgcaggagatgctcggacatgccgatatttccacgacacaaatttatacgcatgtgacgaaaacaaggctgaaggacgtgtacaaacagtatcatccgcgagcttaggagccgctgccagaggggccgcggctttttttgccggattggcggaatacagagaaggttctaattatttgaatcggcattgtcaacaagaatgtaaacggtttatacttgagttgtctgacctctgtaagctacaatggacagatggaagaaaaggaggcttttatgatgtctgaatacaaatataaccgggtatttttaattgtaatggattctgtcggaatcggtgaagcgccggacgccgccgattttaatgatataggcgcaaatacgctcggacatatcgcagagcacatgaacggcttacatatgccccatatggcgcagctcggtctcggactgatcggagacattaagggcgtggaaaaaacggagcaccctcttgcgtactacggaaaaatgcaggaggcgtcaaacgggaaagatacgatgacggggcactgggagattatgggcctctacattgaaaaaccgtttaaagtgttcccggaaggattcccggatgaacttcttcaggaacttgagcggcgttcaggacggaaaatcatcggaaataagccggcttcaggcacggcgattctggacgagctcggaaaagaacatatggaaacgggtgcgctgatcgtttacacatcagcagattccgtgctgcagattgcggctcacgaagatgtcgttccgctggaagagctgtacagcatctgtgaaacggccagagaactgacgcttgatccgaagtacatggtcggccggattatcgcaagaccgttcgtcggagagccgggcagcttcaaacgcacgccgaaccgtcatgattatgcgctcaaaccgttcggccgcacggtaatgaacggaatgaaagacagcggattagacgtcatttccatcggcaaaatttctgatatttatgacggagaaggcattacatcttcccgccgcacggtatctaatatggatggcatggacaaagtgattgaaacgctcggtgaagagtttacgggcctgagctttgccaacctcgttgattttgacgcgctgtacggacaccgccgcgatccggaagggtacggaaaagcgcttgaggaattcgacgcgaggcttccggaagtgtttgaaaaaatgaaagaagacgatctgcttattatcactgcggatcacggcaatgatcctgtccatcacggcacggatcacacgcgggagtatgtgccgcttcttgtttacagcaaaaagcacaaacatacagaacagctgccgcttgcggatacatttgccgatatcggcgcaactattgccgataattttaaaacggaaaagccggaatacggaaaaagctttttatcaagattacagtagggggactttttttgaaacaaaagatcgaacgtgctgctgcatttattaaagaacacgtgaaagaaacaccaaagatcggtctgattttagggtcagggctcggcgtattggccgatgaaattgaaggagctgtcaagcttacatatgaaacgatccctgattttccggtctcaacggtagaaggccatgccggccagcttgtgatgggaacgcttgaaggcgtgcaggtcatcgcgatgcagggccgctttcattactatgaaggctactcaatggatcaggtcacatttccagtccgcgtgatgaaagcgctcggcgttgaatctctcgtcgtgacgaatgcagccggcggtatcaacactgaattccgcgccggcgatctgatgattattacagaccatatcaactttacaggcaccaacccgttaatcgggccgaacgaagctgaattcggagcgagattcccggacatgtcagaagcctatgacaaagagctgtcaagcttggctgaaaaaacggccgatgagctgggcattcctgttcaaaaaggtgtgtatacagctgttacggggccgtcttacgaaacacctgctgaggttcggtttttaagaacgatggggtctgacgctgtcggcatgtcgaccgtgccggaagtcatcgtcgccaaccacgcggggatacgcgtgctcggcatctcatgcatttccaacgcggcggcgggtattcttgaccagccgttatctcatgaagaagtaatggaaatgacggaaaaagtaaaaggcggctttttgaagcttgtcaaagccgtagtcgcacgatctcaaaaataagtcagcataagtcagctgtttcttcggaagcagctgtttttttgtgccctcaacacgaaacattttccagatgaggcgtataaaaccaccggatttggaaaaaataaaaaggattatgaaatggagggctttggagatgaaacgtcttatatccactttgttgattggcattttattaacggcatcagcaccgtccgcttttgcaaagccggacggaaaacatacatcggagctcgctcatgaagccaaaagcgccgtgctgattgaacgcgatacgggaagcattctttataacaagaacagccgggagcgtctggcgccggcaagcatgacaaaaatcatgaccatgcttttaatcatggaagcgcttgacaaagggaaaataaagatgagcgataaagtcaggacgagtgaacacgccgcgtccatgggcggatcacagattttccttgaacccggagaagaaatgacggtaaaagaaatgctcaaaggaattgcgatagcttccggaaatgacgcatctgtcgcaatggcggagtatatcgccggttcagaagaggatttcgtcagccggatgaacaaaaaagcaaaagaattgggattgaaagatacctccttcaaaaacccgacaggactgcctgaaaaagaccattacagctctgcttatgacatggcgaaaatggcgaaggaattattaaagtacgataaaatcactcaatttacgggaacgtatgaggattatttaagagaaaatacagacaaaaagttctggctcgtcaatacaaaccggctgatcaaattttacccgggtgtagacggcgtgaagacgggctttacaggcgaagcgaagtattgtttaaccgccaccgctaaaaaagggaatatgagggtcattgctgtcgttttcggagccagcaccccgaaagaaagaaacgcccaagtgaccaaaatgcttgattacgccttcagccagttcaaaacacacccgctgtacaaacggaatcaaatcgtcggaacggtaaaagtgaaaaaaggaaaacagaaactgatcaagctgaccacatctgagccgatttctcttctggccaaaaagggagagaacatggacaaagtaaaaaaagaagtgaaaatcaacggcaatgtaacggctccggttaaaaaaggagaggtgctcggcagcctcgttctgaaaaaagacggaaaggtgctcgttgaaagcccggtcacggcaaaagacgacatggaaaaagcgggttttctcacttttctgaagcggacgatgggagattggacaaaatttaaataatcatggcgaacgggcactagttttgtcatagtgaaggaattgctttcccgaaaatcgaaacactcattatccgatcatacaaggaggaatgagcatgagccttggaattgactttcatgtcaaagaatccgtgctttgtattcgattaacaggtgaactcgaccatcatacggcagaatcattaaaacaaaaggttactgaatcgctggaggctgacagcatccgtcacattgtgctgaaccttgaagatcttaccttcatggacagctccggcctcggcgtgattttagggcgttataaacaaattaaacagctcggcggagaaatggtcgtgtgcgcgatttcgccagcggtgagacgtctgtttgacatgtccggcctgtttaaaatcatcaggttcgaacaatcggaacaaaaagcgcttttaacgttgggggtggcttcatgaaaaacgagatgcatcttgaattttcagccctcagtcagaacgaatcgtttgcgcgcgtaacggttgcttcttttatcgcgcagcttgacccgacgatggatgagctgacggaaatcaagaccgtcgtatcagaagcggtaacaaacgcaatcatccacggctatgaagaaaactgcgacggaaaggtgtacatctccgttacgctggaggatcatgtcgtctatctgaccatacgtgatgaaggcctcgggatcacggatcttgaggaagcgcgccagccgctctttacgacaaaacccgagcttgagcgctccggaatgggctttaccattatggaaaactttatggatgatgtcacgattgattcctcgccggagatgggaacgacgatacgcttaacaaaacacctatcaaaaagcaaagcgctttgtaattaaggagatttgttatggatgtggaggttaagaaaaacagcaaaaacgcgcagctcaaggaccatgaagtcaaagaattaatcaaaaagagccaagagggcgaccagcaggcaagagacctcctcatagaaaaaaacatgcgtcttgtgtggtccgtcgttcaaaggtttttaaacagaggctatgagccggacgatctgtttcagatcggctgtatcggattattaaaatccgttgataaattcgatttgtcctatgatgtccgtttttcaacttatgccgtgccgatgattatcggagaaatccagcgcttcatccgtgatgacggaaccgtcaaagtatcaagatctttaaaagagctcggcaataaaatacgccgggcgaaagatgaactgtcaaaaacatacggaagagtgccgaccgtccaggaaatcgcggatcatttagaaattgatgcggaggatgtggtgcttgcgcaggaagcggtgcgggcgccttcatccattcatgagaccgtgtatgaaaatgacggagacccgatcaccctgcttgatcagatcgccgatcattcagaagagaagtggtttgacaaaatcgccctcaaggaagcgatcagtgatttggaagaacgggaaaaactcattgtctatctgagatattataaagatcagacacagtcggaagtagccgaacggctcgggatttcccaagtccaggtatcgaggctggagaaaaaaatattaaagcagattaaagtgcagatggatcatacggaaagctgaccttttacgggccggctttttttatttgtgcatcggtggtaatttatggtcttttgcggctgatgaatgagaacaaaagtgaaccacatactacatatataaccacccgaaagatggtgatgcaagatggaaagacgaatatttctcagacttcgccaccgcgtgaaggctcataccggagatatcatcacagtcggcgacgccgcgcagattgcgggacagcaaaagctgaaaaaaaaactgtcggcactgccgctgtataaggtcacgaaaaaagacaaaaatatcgtcgtgctggacatcataaaagtgctgaaaaccattcataccgcttttcccgcgcttgatgtacaggccgtcggcggcgctgaaacgatagtggaaatccattaccagaaaaagcagctgtcagccgttttattcgtcggtgtctggctcctgctttttatcggttcatgtcttgccattatgaattttcatgaagatgtcagtatgagagaagttcatatcgccttatatgaaatcataacgggcgaacggaatgaatacccgtatctgcttcagattccatacagcatcggcctcggtctcggtatgatcgtcttttttaatcacatcttcaaaaaacgcctgaatgaagagccaagcccgctggaagtcgagatgtttaattatcagcttgatctcgatcattatgtcgcaatgcacgaaaatgaagagacgatgaaagatctgcatgatcgttagcattcttttcgttgtatttgtcgggcttggcggagggctgaccgtgggcgcgggctttgtggcttttttaaccgttatgggaatcgtcccccgccttatgcagctgacaaaaacaatgcgctttgtacaggcctacgaaggagcagttatttcaggagctgtgttcggcggctgggaaaccttaaatatgaatcatttttttttatctgaatggctggccgttccggtcgggcttttggccggcatgtttatcggcatgctggccgccgcgcttacagaagtgctgaatgtgcttcccattcttgccaaacggatcggcttcggcagcaaaatcattatattgctgatggccattgtgttcggcaaaatagccggctctttatttcattggctgtattttatccatcattcataaggaggaaccgacgtgacaaacttaaaagaaaattacaaaacaaaagtgaaagactatcagccgaaaccgccatatgtttggaattgcgtcaaagcctttctgatcggcggtttgatctgtctgatcggacaggctcttcaagacttttacatccacttttttaattttaatgaaaaaacagcgggcaacccgacggccgccactcttattttaatttccgcccttttgaccggattcggcatttatgacagactcgggcagtttgccggagcgggttcagccgtgccggtgacgggttttgcaaacagtatgacaagcgcggctctggaacacagaagtgaaggactcgtgctcggagtagcgacaaacatgtttaaattggcgggaaacgtcattgtattcggcgtcgtggcagcctatatcgtaggcctgatacggtttgcttgtgaaaaactgttttcgtaggaggagaaaaaatgaaattaaccggaaagcaaacctgggtgtttgaaaacccgttatttgtaaatgcggcggggacggcagccggaccgaaagaaaaagacggcccgctcggttcgctgtttgataagacatacgatgaaatgcattgcaatcagaaaaactgggaaatggcggaacgtcagttaatggaagatgccatcaactcagctttgcaaaaacagaatttgaaaaagagcgatattgatttgttactcgcgggggatcttttaaatcaaaatgtgaccgccaactacgtcgccagacatctgaaaattccgttcctctgtctgttcggcgcctgttcgacatcaatggaaacgattgccgtcgcatccgcgctcattgacggcggttttgcgaaccgggcgatcgcagccacgagcagccataacgcgacggcagaacggcaattccgcaatccgacggagtatggcgggcaaaaaccggataccgccacttcaacggtcacggggggcggggcggtcatcatcagccaaaacccttctgatatcaagattacaagcgcaacagtgggaaaagtaagcgacctcgggattacggacccgttcgatatgggatccgccatggcgcccgctgccgccgacacaatcaaacagcacctgcaggacttaaaccgcacggcggatgattatgatctgattttaacgggagacctttcaggcgtcggctcgccgatcgtgaaagatttgctcaaagaagaaggctatcccgccggaacgaaacacgatgactgcggtcttctcatctatacgccggaccagcaggtgtttgcgggcggaagcggctgcgcctgctccgcgcttgttacgtacacacatatttttaatcaattaaaatcaggggctctgaacagggtgctcgttgtcgcgacaggagcgcttttaagtccgacaatgatccagcagaaagaaaccattccgaccatcgcgcacggtgtggtatttgagcgggcgggaggtgcatcataaatggaatatctgttggcttttgtttgcgggggaatcatatgcattatcggtcagctgctgcttgacatttttaaactgacacccgcccatgtgatgacaacttttgtcgtcatcggcgccttgttggatgggttcggaatatatgacaaatttatcgaatttgcaggtgcgggcgcgacggttcccattgtcagcttcggtcacagcttattgcacggcgccatgcatcaagctcacgagcatggatttatcgggatcgccatggggatttttgaacttacttccgccggtatatcttcagcgattttattcgcatttcttgtagccattatttttaaaccgaaaggataatgcctgatgacgaaacggaaggtcattcttgtgacagacgggacgtatacgccgccaaaacaattgaatatgccgcggaaaaagcaggcgggcggtgtatttcccaatcaaagggcaatccgtcaaccagaagcggccccgaacttgttcagctgattaaagccgcgccgaatgacccggtgtttgtcatgtttgacgattcaggcctgcaaggggaagggccgggcgaaacggcgctgaaatatgtcgcctcacatcaggacattgaagtgctggggtgattgcggtcgcttctaagacccatcaggctgaatggacgaaagtcgatgtctccattgaccgtgatggagaagtgacggagtatggcgtcgataaaaccggaatgagagaaatggacgagcacagaatgaacggagatacggtgtattgtctggataaattggacgttcctctcattgtgggcatcggcgacataggaaagatggggagaaaagatgacatatccaaaggctcgccgattacgatgaaggcggtcgaattcattttagaaaggagcgaaagtcatgccggaaaaaccggaaaacatgatcaaggtataccgggatcctagaaaaaatgaacaattttttaaagaccgcgtcggtatgggaacgagctatgatgtcggcgtccgcaaagttcgagtattagaccgggaagtccagatttactttgtcaacggattaaccgatactttgtttatcattcatttaatggaacagctcgtcgacgtcaataattatgatgagaatgcggatgaagcgattgacgttgttgaaaacaggcttgtcaatcagcaggtccaaaaagtcaaaacgctcgacgaagcaacagatcaagtgctttccggacttgtggccgttatcgttgaagacgcgggcttcgcctttatcgttgacgtcagaagttaccccggacgcacaccggaagaaccggatacggaaaaggtcgtccgcggggcaagagacggttttatcgaaaatatcgtcattaatacagcattgatcagaagacgaatcagagacgaaaggctccgcgtcaaaattacgaaagtcggcgagcgctctaagaccgatcttgccattgtgtatatagaagacatcgcggacccggaccttgtcagcatcgtcgaaaacgaagtgaatgcgattgacattgacggattgacgatgtctgataaaacagtggaagaattcatcgtcaaacagggctacaacccgtttccgatggtcagatacacggagcggccggatgtggccgccaatcacattttggaagggcacgtcatcatcgtcgttgatacgtcaccgagcgtgatcataacgccgacaacgatttttcaccatgttcagcatgcggaagaatacaggcaggcgccttcagtgggaacatttttaagatggatcaggttcttcggtattatcgcttcaacggttctgcttccgatctggtttctctttgttctcgaaccgtctcttctgcctgaaagattggattttatcggtttaaataaaaatacgcacatcccgatcattctgcaaatctttttagccgatttggggattgagtttctcaggatggccgcgatccatacgccgaccgctttatccaccgccatgggtctgattgcggcggtgctgatcggtcaaatcgccatagcggtggggctgttttcagcagaagtgattctgtatgtatcgatcgccgccatcggatcatttaccacgccgagttatgagctcagcctcgccaataaaatgatacgcctcatcttaatggtgctcgtggccattttccaagtgaaaggctttgtgataggctttacattgctgctgatcataatggcgaatatccgttcgtttcatacgccgtatttatggccgtttttaccgtttaacggcaaggcgctgtggcaggtgctcgtccggacgacagtgccgggagcgaaagtcagaccgagcattgttcacccgaaagaccgtcaaagacagccaagcggttcataatcgcattgaaaccgacagaagattatgatattgtatgtcttaacttatacgggacttgtataaggacagctcaaaagaagctgtccttttcacccataggcggatcagaaagagggaatgagcattgttcttacatggcacaagcagacaaaacaaactaggtcatttggaaatcggaggtgtggacgcgctgtatttagcggagcattacggcacgcctctttatgtttacgatgtggctttaatacgtgagcgcgctaaaagctttaaacaggcattcattgacgcggatttaaaggcgcaggtcgcgtacgcgagcaaggcgttttcttccgttgcgatgatacagctcgctgagcaggaggggctctcattggacgttgtatccggcggagagctgtttacggcggttgcggctggttttccggctgacaggattcattttcacggcaacaacaaaagcaaagaagagttgaaaatggcgctcgatcatcaaatcggctgcatcgtcgttgataatttttatgaaatatccttactcgcggaactgtgccgcaaatcagggcgcacaatggatgtgcttctccggatcactccggggtagaggcccatacgcatgattatattacaacggggcaggaagattccaaattcggttttgatctgcataacgggcaaatagaaaaggcgattgaacaagtattgcagtcagaccatatccgccttctcggcgttcactgccacatcggatcgcaaatttttgatacggcgggctttgtgctggccgcagaaaaaatctttgcaaaactgaatgaatggagagaatcattcggctttgtctctgaagtgctgaatttagggggcggcttcggcatccgctacacggaagaggatgaaccccttcatcccgccgtttatgtggaaaaaattatcgaagcggtaaaagaaaacgcagcgctgcacgcttttgacattccggagatctggattgaaccgggacgctcgctcgtcggagatgccggaacgacgctttataccatcggttcgcaaaaagaagtgcccggcacccgtaaatatgcagcggttgacgggggcatgagcgataatatccgtcctgcgctttatcaggcgaaatatgaagccgtatcggcaaacagaatcggagaacaccacgacaaaacggtatccatcgcgggtaagtgctgtgaaagcggggatatgctcatttgggatatagaccttccggaagtgaaagaaggcgatcttctcgccgttttctgcacgggagcgtacggatacagcatggctaacaactacaaccgtattccgcgtcccgccgtcgtttttgtggaagacggcgaagcgcatcttgtcattagaagagaaacttatgaagacattgtaaaactggatctgccgtttaagactggggtcaaacaataaataaaaaagagaccggaacaatggcgtccggtctctttttgcgttcagctgtcagaacttgatccgctgtctcctgtaaatacagacacgatcgcattccaaatcgaagcgaagaaatcaataactttttgaacaaagcttttgccttcatcggattgaatgaacttcgtgattttgtcttttgccttatcgagctggctgccgacttggccccaatcaatctttgcatttttcattttattaaacaatgaaacgagctggtctttttgagcgtcagtcagtgtaatgttaaggtttgaagccgcatcatcgacctttttctcgattccttcttttgtatcgggcacaccgtttttcgcgaaatcatctttaatgtttgcgataagcgcggaggcgtttttatccccgattttatccccgagatttgaagtggtgacaagctcttggttggcgacctgttttacatcttctgaaatcgctttgtctgatgagacttcatatgccttgatgattcccgttaatgctgcggtgcctgatacctcaaacggcgccgtcacgtatactttcgcatctttcactcctgctgtcatcagggcgtttaagtacatttcatccgtaatggaatcgatattatgggtcttaacgtcaagcccggaccctttctttgccaccgtaatggatgacgaagagatggctcttgtgccgatttgggcattcgatatatattttcccagatattcatgttcttctttatttgtgaccgtcacttttgtcgcgttatcagggacatttaattcgtcaagcactttctgacggttttcgtttgacagatccgcccccagtgtgacgatgacatctccgactgcggcatcggccaggctgattttcggtattgtgcacaatacaacggccgccgccagcaatccaatccacatttttttcaaagcggttaacctccttcttttcacaaatgccgttttgaagcggtttgtgaggacctgcgagaagcagttccgatacatagacggctgtgaagctgttctggtttcattttctttctgcggaagcggggagattcgttttccggctgaaggtgtggtataatagccgcgaaaagaagagcagaggcctcttccttcaaaagaatatcaaaaagaaagccggcttacaattgaaattcatattaaagaaggctttgacaaaaaacaatacggaagtaggaatgagaatgaaaactggttacatcgaaatggaaaacggcagcagaatcgaatttgaactttatccgaatgaagcgcctaatacagtcgctaactttgaaaatctggcgaatacgggcttttatgacggcgttattttccaccgcgtgattccgggctttgtcagccaaggcggagatccgactgggacaggcatgggcggaagcggaaaaacgatcaaatgtgaaacagaaggcaatccgcataaacacgaagccggttctttatcaatggcgcatgccggtaaagacacgggttcaagccaattcttcatcgtacatgagccgcagccgcatttaaacggcgttcatactgtattcggaaaagtgacaagcggtttagagcatgcgaaaaacatgtctaacggagacaaaatgaaagaaatccgtgtagaaggataatgacggaaaacccgcctttttcaggcgggttttttttatgtatatgaaaattctcatgtgtaaatcatgaaaaaatacatatatgaacatcggtgatcattctggtatagtgaaaaagaccgattacaacaatgaaaagaggtagaaacgttggttcaattggcaaccgttttatttgtcattatcattctcgcacttatgatttggttcagggtaaaaaagggaaacaggccgattaaaggcggcggcttaggcatcattctcccgcttttgattatcgccgtcatttttacattcagtatcagccagctcatgaatatcccgggaaagccgtttcattttcccgctctttgggagctcgccatcgccggactgttaggcgcggtattcggtatcatcatgctgtcgcaaaccgcctatgaaatccgggaagacggctttgtctactccaagcggaataaaaactttaaatatgtcattatcgcgattattgcgatccgtatcgcactcagccaatatttcaaaagcattgacgcggctgaattcgccgttttaacgatggagcttgcttttgtgtatttgtgcatttggcggatcggaagcttcgtgaaataccgtaaaatcagcagatccggcttataaaatgaaaaaaagggatggggtgcggggcttatttgccctctgtgcagggattcatggtaaaataaaaatgaccatggctaatgggaggaaatcacttgaaatcagaaaaagaaaaaacttctaaaaaaagcgccgtacttgattgggcgaaagccattatcatcgctgtcgttctggcactgctcatccgaaactttttatttgccccttatctcgttgatggtagatcaatggatccgacgctgcatgaccgcgagagaatctttgtcaatatgacggtcaaatacataagcgacttcaaacgcgaccagatcgtcgtgctgaacggagaaaatgagcactatgtcaaacggattatcggacttcccggcgacacggtgcaaatgaaaaacgatcagctgtatatcaacggcaaaaaagtgtccgaaccgtatttagcggcaaataagcacaaggcgaagcaagacggctatgaccggctgacagaagacttcggcccggtgaaagtgccggacgacaaatatttcgtcatgggtgataaccgcagagaatctatggacagccgcaacggcctcggtctttttacaaaaaaacaaatagcgggcacatcaaaattcgtcttcttcccgtttaacgaaattcgcaagacgaaataaaccgtacaggcagttttcttcatgagaaaactgctttttttatataaatttatctctccaccctcaaaaacagaacataaattcgtatatctatttaatagatagaaagttttacagatacatgaaacatcttccctttatgaaacgttatatgaataactcacgcagggaagaacggttttctattcatgaaaaaaaggaatatgacatagtaatgaatagattgatacgggctggaggtagaaaaatgggaagaattaaaacaaaagcagccattttacttgtactgctgctgttattagcgggcggttatatggtcataaacgatattgaactgaaagacgtgccgactgcaatcggacaaaccctgtcccaggaaaaagaagaatatacagtcaaaacatataaaattacgaaaatcgaaggaactgagtaccacggtacggcagcgaacggcacaaaaattatttttaacggcgacaagctgaagcaggatctctccgatgtgcaaaaaggtgataagattaaagcgtatttcagcaaatcaaaccggattgacggcttattgaaggtcgtcaaagtgaacgaataaataaagacgccttttatgggaaaagggcgctttttatttttctgaataatgaggtgcaaattcattgcgcctgccgcaaaggatgttataatagcggataaggacaaaaaaatattgattgtatccttcggggctgggtgaaaatcccgaccggcggtaataaggcgctttgcgctttacagcccgtgacccgtatgcatctgtatacggtggattcagtgaaaagctgaagccgacagtgaaagtctggatgggagaaggatgagagaagctatgcaaaaaataaacttactgtatagtcttatttcctatggattaaaactggcaaagccccgaactgtgtaaacattcggggcttttttgacgccaaattgcgtggaagaagggagggataacaatggatgaatattatatgaatacggcaatagaacttgccagacgcggtgaaggacagacacagtccaatcctcttgtcggcgctgtcgtcgtcaaaaacggacagatcgtcggaatgggcgcccatttgcaatacggagaagcgcatgccgaggttcacgcgattaatatggccggcagacacgcaaaaggcgccgatttgtatgtgacgctggagccttgcagccattacggaaaaacaccgccatgcgccgaactgataataaagtcggggataaaaagggtgttcattgctgtgaaagatccgaatccgcttgtagccggaaaaggcatcggaatgctggaagcagcgggcatcgaagtgaaaaccggccttctcaggcagcaggcagaagagctgaataaaatgtttcttcacttcatgcggaccggacttccgtatgtcaccttgaaagcggccgcgagccttgacgggaaaacagcgaccgaaaccggtgacagcaaatggattacatcagaggcggcaaggcttgatgcccagcaatacaggaaatcgcatcaaagcattcttgtcggagcaggcacagtcaaagccgataatccgagcctgacctgcaggcttcctgatgcggtgaagcagccggtcagagtgattctcgatacaaagctgaccattcctgaaacggcaaatgtgctcactgacggcgctgcgccgacatggatatttacggccaaaggtgcagacgtgcaaaagaaagaccggctgaccgcactcggaataaaagtttttccgctggaaacagaccgcattcacatccctgaggtgctcagtgttctcgctgaaaacggaataatgtccgtttatgtggaaggcggagcatccgtacacggaagttttgtgaaggaaggctgtttccaagagcttcatttctatttcgcccctaaattaatcggaggaacgcttgctcccagcttgatctccggtgaaggttttcaatcaatgaaagatgtcccccatttgcaattcacacaaatcacccaaatcgggccggatataaaactgacggccatacctaaagatggaaaggatggtgacgatgtttacaggaatcgttgaagaaacaggcacgatccaagcaatcgaaaagacaggcctttccatggcattaaccatcgccgcttcaaaagtgacaagtgatgtgaaacttggcgacagcattgcggtaaacggcatctgcctgaccgtaaccggattttctgacaatcaatttacggttgatgtcatgccggaaacagtgaaatccacttcgctgaacggcttgtcaaaaggcagtaaagtaaacctggaaagagcgatgtccgccaacggacggttcggcggccactttgtatcagggcatgtggacggaacggcggaaattacgcggatcgagaaaaaaagcaacgcggtctattacgatttaaaactttcgccggaattgacaaaaacgctcgtattgaaaggttcaattacggtagacggcgtgagcctgacgattttcggtctatcagatgaaagcgtgacggtatccatcattccgcataccatctcagaaacgatttttcagacgaaaacagtcggatcgaccgtaaatattgagtgtgacatgatcggcaaatacttataccgctttttgcacaaaacagaacaaacgaaaagcaatcaaactatcacggaagcctttttaagcgagaacggcttttagaaaggaagatcgatatgtttcatccgatagaagaggcgttagaggcgctgaaaaaaggtgaagtcatcattgttgtcgatgatgaagacagagaaaacgaaggagatttcgtagcgctggctgagcatgccacgcctgaagtggtgaattttatggcgacccatgggagaggtctgatctgcacgccgctgtctgaagacatcgccggccggctggatcttcacccgatggtcgatcataatacggactcacatgagaccgcctttacggtcagtattgaccacaggctgacaaaaacgggcatcagcgctcaagaacgttcttttaccattcaggcgctgttgaacgaggaatctgtgtctgacgattttcagcgtccgggccacattttccccttaatcgcaaaaaaaggaggcgtcctgaagcgggcgggccatacggaagcagccgttgaccttgcaaaagcctgcggatctcagggagcgggcgtcatttgtgaaattatgaatgaagacggcacaatggccagagtgccggagttagccgaaatcgccgaacgtcaccagctgaaaatgattacgataaaagacttaatagagtaccgttacaacattacgacacttgtgaacagagaagttgatattacgctgccgactgacttcggcacgtttagagtttacggatatacaaacgaggttgacggaaaagaacatctcgcctttgtcatgggggatgtcccgtttaacagcgaacccgttcttgtcagagtgcactcagaatgcctgacgggcgatgtgtttgcatcccatcgctgtgattgcggacctcagcttcatgccgcgcttgcgcaaattgctgaagaaggccgcggcgttctattgtatttgcgccaggaaggcagaggaatcggtttaatcaataagctgaaggcgtaccgattgcaggaacaagggtacgacacggttgaagcgaacgaagcgctcggctttctgcctgatctgcgcaactacggcatcggcgcccagattctccgcgacttaggggttcagcatatgaaacttttaaccaataacccccggaaaatcgccggcctcgaaggatacggtctcagcatttcggaacgggtgccgcttcaaatggaagcgagtgagcataacaagcagtatttacagaccaaaatgaaaaaacttggacatctgcttcatttctaaaaacaaatctcacaaaaaaggatggataacatatgaatatcatacaaggaaacctagtaggaacaggacttaaaatcggaatcgtcgtcggcagatttaatgaatttataacgagcaagctgttaagcggagcggaagacacgctgcttcgccacggtgtagaatcaaacgacattgacgtcgcttgggtgccgggagcgtttgaaatcccgtttgcggcaaagaaaatggcggaaacgaaaaaatacgatgccgtcattacgctcggcacggttatcagaggagcgacaacgcattatgactatgtctgcaatgaagcggcaaaaggcatcgcccaggcgggaacggcgacgggcgtcccggttatcttcggcatcgtgacgactgaaaccattgagcaggccatcgaacgagccggaacaaaagccggaaataagggagcggattgcgcagtatctgccattgaaatggcaaatttaaaccgttcatttgaataatttgttgaaaagcgtttaaaaccgcggcgaaaatgatataatgtgagaaaacggatcgcctttatgtatccgtttgataggacatgaatggacattttggatatagaggggtttttatgttaattcgttataaaaaatcgtttgaaaagattgcgatgggtcttctgtcatttatgccgaatgaaaaagatctcaagcagcttcagcagacaataaaggactatgaaacggatactggccgccagctctttctttggaaagaggatgaagatatcgtcggagcgatcggagtcgaaaaaaaggactcagaggttgaaatccggcatatcagcgtgaatccttctcaccgccatcaaggaatcggaaagcaaatgatggacgccttaaaacgtctgttcaaaacggaggcactcgttccgaatgaattaacgcaaagcttttttgaacgctgtcaacatcaaaaagatcaggatatctcatataataactgacaaatgctcccggaatcttcacggtttcgggagctgttttgatatagaaaaagcagggctgaccgtcagcctctgcttttttttcttctctcaatttcccgttcgcgttccttaatgacatccgtcctgtcccgcaggcggtgtttatgaataagaaaggtatctgatacgccgtcttgcccccatgtatagccctttcggcggcattcggcaagacatgcttctttcagggcttcatctgtaatcggaagcataacacttctgtaaggcaggcccgcttctatatcgtctgacagcgtttctatcagctcaatcagcttcggatggctgagaccgagagaacagaccgcctgcttttcagaccggagaatacgtaagctgttggcaatcagccgtttcgccccggcttcatttcccctgcgctggtgatacagagcgacggcaagctgaatcaggccgacccaatgaatgctccgcttttcagccgggctttctttccaatattcctctaacagttcatgacattcaaaataatctcttgatgcgtgaaattcggccaaaaagccgatataagctttaggatacaagccgcttcctccttttatgctaaaaccagtgtaccacagcgctttgaaaaggaaaaaagagcggcttggtgtctgaagcctgaggaactagcagatgtaagatgctcctacgacaacgagcaaaataaacagaacgacaattaatgcaaaacctccgccgaaacaagctccgctcatgtgaaatcagcctccctttgtttcaagtttacacggctatcctatgtgcatccgcctttaaaggtataggcgtatatcttctttttcagtattttctaaataacggaggacgtgtataaaagtattggacgagagcatttcggtggattatactaaagggtagccagtttttccggcaatgagagtgatactgaaaatggtgagataatggtagaatatcaagtgaaaattgatacgtttgaaggcccattggacctgctgcttcatctgattaaccgtcttgaaatcgacatatatgacatacccgtggcaaccattactgaacaatatttattatatgtacatacaatgcaagagcttgaacttgatgtcgccagtgaatatctggtcatggcggcgacgcttctcagcattaaaagcagaatgctgcttccgaaacaagaagaagagctgtttgaagacgaaatgcttgaagaagaagaccctcgggacgagctgattgaaaagctgattgagtatagaaagtataaaaccgctgcgaaggatttaaaagagcgggaagaagaaagacaaaagtcatttacaaagccgccgagtgatttaagtgagtatgcaaaagaaatcaaacagaccgagcagaaactgtcggtgaccgtttatgacatgatcggcgcgtttcaaaaggtgcttcagcgtaaaaaaatcacgcggccgaaagaaacgaccattacaagacaggaaataccgattgaagacagaatgaaagaaatcgtaaaaagcttaaaaacggcggggagaagaataaacttcacggagctttttccttctcggcaaagggaccatctcgtcgtgacgtttttagcagtcctggaactgatgaaaaatcagcagattatcattgaacaggaagaaaacttttcagatatatacattacggggagtgaatccattcatggcgtttgatatcgtgaattggaaagcgattgtggaagccctgctgtatgcggcgggtgatgaaggactgaccaaaaagcaattggtgacggtgcttgaaatagaagaagcggaactggccggaatcatggaagaagtggccgctcagtacaaggaagacgacagaggcatcgagcttaccgaatatgcggatacgtatatgcttggaacgaaaaaagaattcgtgccttatttgaaaaaactaatcgaagtgccgtcaaaagggctgtcgcaggcttctttggaagtgctggcgatcgtttcgtacaagcagccgatcacacgggcggaaattgaagatatccggggcgtgaagtctgagcggattctgcacagcctcgtgtcaaaagcgctgctgtgtgaggtgggccgcgccgacggtcccggccgggcgattttatacggcacgacaccggtatttcttgaacaattcggcttaaaaacattggaggagctcccgccgcttcctgaaaatgcggaggaagacgttctccaggaggaagccgatttattctttgaaaacttcaaccaaacttttgaggatattaaataataatcgtttttcatcatacgatagtagggaaaggccattgatgaatgacgcaaatgacgacgtacaagagaggaaggaaacggacggaaatgggaaattcgattgtgagggcccatactgaagaaactggtgaatttttagccgaggttgtcacgatggtcagcagctatttaaatcatacaacattgccggagatgcgggctcaaggagaggcggatgaggcatactgccgcgacgtgctcagtgtgctgaggaggatgaccgtcttttgcgaaggcgcccaggaagcctgccggcggctcttaatgcaggagccgtttcatgaggtgagagcggaaaaaacgctgtataaagtgtatcatcagtgcgtggaagaatttttcatgccaaaaaaggatacatggtacgaaaacagccgcgccgcttatacaggccaaagcgcgattgagttctaccagcaagtgccggactcgctgcggagccttctgctttcgctcagcagtgaatttctgcggatgcgggaagaattggcgcaatatgaagcatcaggctcaaatatggcatcagtcagataaaaactcttccttttgggagagtttttttatgtgaaagtgatgcaattggtattcataagtcatggacaggcgcataaacttgtacaaacccacaacaaggacgtgagcattcatgcgctttctcaaaaaagctgccgtatttcttttgacttttgttattcttttttccattacagacggcaatacggcacatgcccaaatacatgtcagcgcaaaaagcgcgattattatcgacggagcatctggcagggtgttattcgccaaggatgaacatcataagcggcggattgcaagcattacgaaaatcatgacggcggtgctggcgattgaatcaggaaagatggaagagaccgtgacggtttccccgaatgctgtaaaaacggaaggctcagccatttatcttcagccgggacaaaaagtaaagctgaaagatcttgtatacgggcttatgctgagatcaggaaatgacgccgctgcggcaatagctgaatatgtcggcggaagccttgacggttttgtatttatgatgaacaaaaaagccgagcaaatcgggatggaaaatacaaaatttcaaaatccgcacggactggacgaccatgaaaatttatattcaacggcgtatgacatggcgcttttgactaaatacgcaatgaaaatcaaggaataccggaccgtttcaggcacaaaagtgtataaggcggaaacgatggaccgggtatggaaaaataaaaacaagcttctgactgggctctaccgttacagcacaggcggaaaaacgggttacacaaaaatcgcgaaacggacgctcgtttcgacggcttcaaaagacggaacggatctcatcgcggtcaccataaatgatccggatgactgggatgaccatatgaatatgtttaattatgtctttgaacactataaaacctatgtcgtcgctaaaaaaggcggcattccgaagctgaaaaagacgttttacggaaaacacgcttttattgcccgggatgtcaaatatttattaaaagaggatgaaatcgacgatgtaaaaatccgcacaaccttaataaaaccgaaaaaagcctggaaaaaggacgcctctctcattcctgatgtcgtcggccggatgactgttatgcatgatgggaaagtgatcgccaagattcccgtctattatgaaaacgagcgccataaaaaaccgaaaaagcatttcattgagacgtttacgagcctgtttatgagcgcggcgggcggttcgtcatggtcaatttaatctgggtatgtctgacggtaatcggacttgtctttgcgatgtttaacggtaccttgcaggatgtgaatgaagctgtttttaaaggagcaaaagaagcggttacgatctcgttcggattaatgagcgtgctcgtcttctggctcggcctgatgaaaatagccgagcagtccggccttttggatatattcagcagaatgtgccgcccgtttatctctaagctgtttcccgatattccccctgatcatccggccatggggtacatcttatcaaatctcatggcaaactttttcggactgggaaatgcggcgacaccgctcggcattaaagccatggagcagatgaaaaagctgaatggaggtaagtctgaggccagccgttccatgattacctttttggcggtaaatacttcgagtattacattgataccgacaaccgtcattgccgtgcgcatggcttattcggcgaaatcaccgaccgatatcgtcgggccgaccatcttagcgactttaatttcgggaatcggcgcgattttcattgaccgctacttctggtaccgccgcaaaagaaaagggaggtaagcgaatggaaatggtgaattggctgtctttagccatgattccgattattatcgccggtatattgatatacggcacgatcaaaaaagtgccgacgtatgaatcattcgttgaaggcggaaaagaaggaattgagattgcgttttccatcattccgtatttggtcgggatgctggtggcgattaccgtattccgggcctcaggcgcgctggattttgtcatggggctgtgcaagcctttctttacagcgctcggcattcccgcagaagtcgtgccgcttgctctgatccgcccgatttcggggacggcggcgctcggcatgacgacagatctgatcgccgtgtacgggcctgattcatttatcggcagactggcctcggtcatgcagggatcgactgatacgacgctgtatgtcctgacggtgtatttcggggcggtcggcatcaaaaaaatgggggatgctttaaaggtcggtcttcttgctgatctgatcggggtggttgcatcaatcatcatagttgcgttattatttggaagcgcctgaaatcaggcgctttttatatatcagaataactctccttgaaaaagcttgtttgttcaaggggaaaaaagtaagattatacttgaggtgaacgacatggaaagactgcaaaaagttattgctcatgccggcgtggcatcacgcagaaaggcggaagagctgataaaagaaggaaaagtaaaggtgaatggaaaagtaataacagagctcggcgtaaaagtgaccggttctgatcagattgaagtaaacggattaaaggtggagcgggaagaacccgtgtactttctgctttataaaccgagaggagtgatctcagcagctgatgacgacaaagggcggaaagtggtgaccgactttttcaaagaagtgccgcagcgcatttatccgatcggcaggcttgattatgatacgagcggacttttattgctgacaaatgacggcgagtttgccaacaaactcatgcatccgaaatacgaaattgataagacgtacgtcgccaaagtgaaggggattccttccaaggaacttctgagaaagcttgagcgcggcattcagcttgaagaaggcaagacggcgccggccagagcgaaaatgctttccctggacaaaagaaagcagacgagcattattcagctgacgattcatgaaggccgaaacagacaggtccgccgcatgtttgaggcgatcggtcatgacgtgctgaaactcaaacgtgaagaatacgcatttttagatttaagaggcctgcgcacaggagacgcaagagaattgacgccgcatgaggtgaaaaggctgcgggctttagctgaacacggtaaaaacgctttctaattttcacataaccttcaaaaattacaaaacgtgtagatgatataattgaatggatttgcagacaggggaggggagcagtgtacaatgaacaaaaaacggcggcgtttattcattcggaccggcatccttctcatcttactctgcgcgctcggatataccatctataatgccgtttacacaaacggagagcgtatatctgaggggtccaaagccccgaatttcgcgctgaaagatacagagggcagactcatagaactgagtcagttaaaagggaaaggtgtttttctgaatttctggggaacgtggtgtgagccgtgcaagcaggaatttccctacatggagaatcaatacaagcattttaaagacctcggtgtcgaggtggttgcggtaaatgtcggcgaatcaaaaattgcagtacataattttatgaaaacatacggcgtcaatttcccggttgcgctcgatactgaccggcaagtgctggacgcgtacggcgtatcacctattccgacgacatttttgatcaatcccgacggaaaggtcgtgaaagtggtgaccggcacgatgacagaacgcatggttcatgactatatgaatttaattaagccggaggcgtcttcatgaaaaaggtcaaatgtgagtgcgggcacgtgaatccagccgggacggttttgtgcgagtcgtgcgggaagccgcttgatgatcaaaaatcgccgcttgccgatatgcggtacgacggcagcgcaaggcgttcgcaaacatataacaaaacaatcgtagataaggtatggaacttcttttcttccgtaaaagtcggaatatggctgatcgtcattactctggcggcgtctgctttcggcacggtttttccgcaggaagcttatctgcctccgggcgcccagccggatacatattatgaacagcagtacggcataatcggccaactgtattatttgctggggtttcatcacctgtacggctcatggtggtatatgctcctgatcgcatccattggcatatcactggtcatctgcagcctggatcgggtgattcctttgtacagggcgcttaaaaatcaaggagttcggcggaatccggtctttttgaagaggcagcgtctatacagccggacagaaaccgagctgagcggggatgcggctgatagcctcagaacacgattgaaaaaaaagcattatagagtgcgagaacaagagggaagcatcctggcggaaaaaggccgtttttcaaggtggggaccctatgtcaatcatatcggcctgatcatttttctgatcggagccatgctgagatttgtacccggtatgtatgtcgatgaaacgctctgggtccgtgaaggcgaaaccgcccagatccccggtacagacggcaaatattacttaaaaaacaaccggttcacgatgcagacatataacaaagacactgagaaaaaagtattcgccgacgccattgacagagccggaaacggcaaagtcgccaaatccttcacaacggacgcggttctgtacaagagggaaggcgacattgtattcggtgaaaagccgaagcttaaaagagtcaaagaaaacaatatccgcgtcaatgaaccgctgcgctttgactcctattctgtgtatcaggtggactataaagaaaaccagctcgatcagatggtatttcagctgatcgaccaaaaaacaaaacagtcattcggcaaactgaagatcaatcttcttgatcccgacacggactacgatcttggtaacggttacaaagtgcagattgccagttatcttcctgatttttattttaacaaagacggagaaccgagcacgaagacgaaggttcctaacaatccggcttttgtctttaaaatcacggctcccgacaagccgaaaggggagaaaagttttgttgcgattcagcagactgttgaaggttccgaaagtaacaagtacaaattaaaattcgaccatgtggaaacgaaaaacattacaggactcaccgtcagaaaagacttaaccttatgggtgcttgccgtcggcggcgcgatctttatgatcggcgtcattcaagggatgtactggcagcacagaaggatctggatcaaaacaggtgatcatgaagtgcttgtggcgggacatacgaacaaaaactggttcggtctgaaaaaggatatcgaatttgttcttagcgggaccgggattcaagagccggccgatcaaaaagaattggccaaaaatcaggcctagtgaaaaaggagtggtgtcatggcggagctgagcgcaaattttctttatgctgcctttttgatttatttaattgccgtcccggttttcggcggcgccatccggggaacaaaaggtgcgaaggacggtaagggccgctggtcggctatcggaatcacgttaaccattttcggatttctttgtcacctcggctactttattgcgagatggtcggcaagcggacatgcgcctgtcagcaatatgtttgaatttacgacgtcattcggcatgatgcttgttctcgcttttattattatttactttatttacagactgccttcattaggcatgttcacattgtctatcgcgcttttgcttatcgcatatgcaagcatgtttccgacagacatcacgccgcttattccgtcactgcagagcaattggctgtacattcacgtcacgactgcggcgctcgggcaggcgattcttgcgatcagttttgtagccggcgtcattttcctgttaaagcatgtcgaccaatccagaccgggcaaaaaaacgttctggcttgaagtcatcatgtttatactcgtgacgaccgtggcatttatcgccgtcacgtcggcattccggctggcggactacaaagcagaatttaattgggtggataaaaaagaggctaaaagcgtgatgatatatgatatgcctgcgcttgtcggcccgcatgacggagaactgcttacggaaggcgcaatgaagccgcttattgagcttccggccattttttcaggcagaaaggtcaatacggtgatctggtcgtttggcgcaggtctcgttttattcggggcgctcaggctgatattcagaaagagaatcagcgctcttataagcccgctcgtcaaaaatgtgaatctggacttggtcgatgaagtcggctaccgcgctgtttccatcggttttccggtattcacactcggcgcgcttgtgtttgcgatgatttgggcgcagcttgcatggacgcgtttttggggctgggacccgaaggaagtatgggcgctgatcacctttttattttacgcagcgtatttgcacttgcggctgtcaagaggctggcatggcgaaaagtccgcgtggcttgccgtcatcggcttcgccattattatgtttaacttaatttttgtgaatctcgtgcttgccggacttcattcgtacgcatagatgcaaaaagccgatacagttctcaagctgccgcacagtttgttaaaatgaaagtaacagaaggaaagcagggggaaaacgatggatcaaacaaatgaaactaaaatattagtagtagatgatgaagccagaattcgacgccttttaagaatgtaccttgaacgggaaaactatgtgattgaagaagcggaaaacggagacgaggccattaaaatggggctggcatcagattatgatctggtgctcttggatttaatgatgccgggaacggacggaatagaagtatgccggcagctcagagaaaaaaaagcgaccccgattatcatgctgacggcaaaaggggaagaagccaaccgcgtccaagggtttgaagcgggtacggacgattatatcgtcaagcctttcagcccgagagaagtggtgcttcgggtaaaggcgcttttaagaagggcttcccaaacatcttatctgacagccaataccccgacaaaaaatgtactcgtcttctcgcatctatccattgatcatgatgctcacagggtgactgcggacggcacggaggtgagcctgacgccgaaggaatatgaactgctgtacttcctggcgaaaacaccggacaaagtgtacgacagggaaaagcttttaaaagaagtgtggcagtatgaatttttcggagacctcagaacggtggacactcatgtcaaacggctccgtgaaaaattaaacaaagtgtctccgggagcggcgaaaaaaatcgtcaccgtctggggagtcggatacaaatttgaggtaggcgctgaatgaagttttggaaaagcgtagtaggaaagctttggtttaccattctttcactcgtgttaattgttttatttattttaacggtgctgcttctggaatttatagaaaattaccacgttgaagaagcggaaaaagatttaacgcagcttgccgataaaattgcggtcataatagaaaatcatgaagaccagccgcttgccagatccatcacgtgggaactggcggacaatttaacgagcatcgcgatcattcaggatgataagcatgtctggtattcgcccaatgacgataatcatttatcctctattacattagagcagattaaacatgaccgggatctgcacaaggcgctgacagaccgcaataaagtaagcaaacgcgcggtccccaaaaatgccggttcggataatgaacggctgatcgtcggagtgccctatgaaaaagacggcaaaaaaggcatggtctttttatcccaatcgctgcttgccgtcaaagatacgacgaaacatacgacacgctatatttttcttgcggcgggcattgccatcgtcttgacaacgtttttcgcattctttttatccagcagggtgacatatccccttcggaaaatgcgggaaggcgcccaagacttggcgaaaggaaagtttgatacaaaaattccgattctgacccaagatgaaatcggggaactggccattgcctttaatcagatgggacggcagctcaatttccatattaacgcgctgaatcaggaaaaagaacagctgtccaatattttaagcagtatggcagacggggtcatcaccattaatatcgacggcaccattttggtgaccaacccgccggccgaacgttttctgcaggcatggtattatgagcagaacatgaacattaaagaaggagacaaccttccccctgaagcaaaagagctgtttcaaaatgcagtgaacacggaaaaagagcaaatgattgaaatgacgcttcaaggaaggtcatgggttttattgatgtcgcctctttatgcggaatcacacgtccgcggcgccgtggccgtgctccgtgatatgaccgaagagcgcaggctggataaattgcgtgaagacttcattgccaatgtcagtcatgagctcagaaccccgatttctatgctgcaaggatacagtgaagcgatagtggacgacattgcaagcaccgaagaggagaaaaaagaaatcgcgcagatcatttatgatgaatctcttcgtatgggccggctcgtcaatgatttactggatttggccagaatggaatccggacatacgggtctgcgctatgaaacggtaaacctgcatgaatttctggagaagatctcccgcaaattttccggtgtagcgaaggaaaaaggcgtttcgctcacagaggacatctcggtgtctcagccggagtgtgtctttgacgaagacaaaatggaacaggtgtttaccaaccttatagataatgcgctgcgccatacggagtcaggcggaaacgttcatatcgcggctcataccgtaaaagacggactgaaaatcgatatcaaagattccggctcgggaataccggaagaggacctgccttttatttttgaacgtttttataaagcggacaaagcaagaacaagaggcagggcagggaccggactcggactcgccatcgtaaaaaatatcgtggaagcccacggcggctcaattgcggttcacagcagcatcgacaaagggacgacgtttacattttatattccgacaaaagcgcaggatgacgtctgaaattgacgaacaatcttgttccatacgaaacacccgcagaacatgcgggtgttttttgtttttttctcctttaaaaatttaagaatatgttaatataaattcccttccaaattccagtttctcgtaatatagttgtaatgtaacttttcaacgcatttttacgacaaaaaagtgaacggaggggtttcccatggaagaaacctttcagatattatacgatgcataccatcaagatttatatcaatttttattttatatggtaaaagataagtcgcaggctgaagatttgacgcaggaagtgtatatccgcgtcttgaattcctatcatacatttgaaggaagaagcagtgaaaaaacatggctgttgtccatcgcacgccatgtggcgattgactggttccgcaagcagcagacgatcagacagcgtattatgggtacgtttgattgggatacacaagatgtcagagatcagcatttgcttccggacgaactcgccgtacagcatgaaaatgtccgggaaatttataccgcgcttgatcattgcaccattgatcaaagagctgttattatcttgagatttattcagggatattccattcaggaaacagccgccgctctccgcttctcggaaagcaaagtcaaaacgacccaacacagagggctcaaaatacttcggaaacagatggagcttttgagggaggagctaatggatgatgaagtcatattggaacgaagaaagagtagaggagttgttaagacaacttccggcggttagagatcatcgttcacccgaggccatttaccggaatattgaaacgggtaaaccgtacaggaaaaaaccggcccgaagctggatcggccccgctgcagccggcatctgcgcattgtgcatcgctctgattatttctcctcacctgatgacaaacaaatctgccggtgatcttacagctgacagcggtcaagctgaaaaagccagtcagtcagctgctgtcaagccggatcagaagacgtttgtcgtttctaacgaaaacaaaaacaattacattactttggcgtttgccgattcagatacatccgccgtcattccggtcagttttgaaaaaaagaagcctgacgaatcggtttcagaggcattatctgatgcaggaaacttagaagtgcccgaatctttcctctctgtgccgaaccttttggacggtgtgcaggtaacggcggataagaaggatttgcttgtgcaggtaaacggacgtctttctatcgaatcagctgccgattctgatttattgaaaaagatgctgaaagagactttgacatggagtccttacgagcggattaaattgaaaaaggttcaaaacggagacggacaggatttttataaatcttacggcatttccgctgagatgtccgtacataaacagacaaaccgggcgtatttttcttacagcgacagtctgggacaagagtatctcatcccgtctgaacaaacctattattcagtatatcaggctattgacgggatgaagacaacagacggaggctcacagaccgcgagcattatagaagcagatgcgattgcatcggtatcggaaagggaagacggcgagcagctgcggatccaattgtccgaaaaacataaagttgaagattcgctggaaggcattttaatgatcgaagggcttttgttaaccgcgaaggaattcggttattctgaggtgctgttcacacatgcgcacgcaaagaaaatcggtaattatgatgtgacaaaaccgattgctgtgcctgccgcgcctaatccgcttccgacccattaaacgtaaaaaaacccaaaacatatgaatgttttgggttttctgttggttacggaaggtcaatcagtttaacggaaacaatatcctgaaccgaagtcagctcattgacgactttatcatctaaatgtttatcaaaagaaagcatcataatggcttctccgcctttttctttacggcccacctgcatggtagcgatattgatatcgttatcgccgaggatgcgtccgacgcgtccgattacaccagtcgtatcctggtgctggatataaacgaggtggccggcaggatttaagtcaatattaaagccgttcagttcaacgattcgttcaccgaagtgagggatatacgtagccgttaacgtaaatgtgctccggtctccggttacttttacgctgatgcagttatcatatcctgattcattggaggaaatcttctcgctgaagctgataccgcgttcttttgctacaccgcccgcgtttacttcattgaccgttgagtctacacgcggttttaagaaaccggacagcaggctttttgtaataaatgatgtttcaagtttggcgatggtgccttcatattgaatcgcaacatctttgacgggttccttcatacattgtgatacgagacttccgattttatcggcaatttggtgataaggctggatttttttgaattcatctttcgtcatcgcaggcaggttgatcgctgacatgacaggcagaccttttgcaaactgcagcacttcttcagaaacctgtgccgcgacattcagctgtgcttctttcgttgaagcgcctaagtgaggtgtggcgatcaccagcggatggtcgggaagctttgattcaactggcggttccacttcaaacacatcaagggcagcgcctgcgacatggccgctttccagcgcttccaaaagcgccgcttcatcaataatgccgcctcttgcgcagttgataagacggacgccttttttcgttttggcaatggtttctctgttaagcaatccttttgtttcctttgttaaaggcgtgtggacggtaatgatatccgcgctttcaagcacttcttcgaatgtccggctgtttacgccgattttgccggctctctcttcggttaagaaaggatcgaatacatgaactgtcataccgaacgctctggcgcgctgggcaatctcgcttccgatccggcccagaccgacaatgcctaaagtctttccgtagagctccgccccgacaaaagccgtccggttccattctcttgattttactgagatattggcttgcgggatgtgtctcattaatgaagaaatcatcgcgaatgtatgctctgccgttgaaatggtgtttccattcggcgcgtttatcacgataactccatgttttgtggcctcatcaatgtcgatgttgtctacgccgacaccggctctgccgacgatttttaaagaagtcatctttttaaacaattcttcggttacttttgtggcactgcggactaacagggcatcaaaggtatgtaattcatcttctgcatccgcgacgtttttttgaacaatttctataaagtctgattccatcagcggctttaagccgtcattgctcatcttatctgagaccaaaactcgaaacattgttagatttcctcctagtttagctgactaaatatctgataatttatcatattctcaatagagtgtcaatgtgtattgacgcagtaaaggagaaaaggaaaccgctgaatcagctgaaattgggcttccccaatattttatttaaatttgagcagttctctatacaattacaatttgatcatatataatgtgaataaattcataagatcaatcttcggggcagggtgaaattccctaccggcggtgatgagcgtcacgctctaagcccgcgagctgcttcggcggcaggatccggtgagattccggagccgacagtatagtctggatgggagaagatggaggttcagcagacgttttgatgcttatatcaaacgtttctttgccaagccttagtaagctcccgctttttaacaaaagcggtttttttattggggcgcaaaagaacctttcctcttttcgagagatttgatcgaaaaggagagagcattgtgaaagtaaaaaaattagttgtcatcagtatgcttagcagtattgcgtttgtgcttatgctgttaaatttcccgtttccggggctgccggattacttgaaaattgatttcagtgacgttcctgcaattatcgctattttggtttacgggcctgcggcggggattgcggttgaagcgattaaaaatattctgcagtatatcattcaaggaagcatggccggcgtgcctgtcgggcaggcagccaattttatcgcggggacgctgtttattctgccgacggcgtttatgtttaaaaagctcaattctgcaaaagggcttgcagtgagcctgctggccggaaccgcggcgatgaccgtgctgatgagtattttgaactatattcttatcctgcccgcgtatacttggtttttacattcaccggcattgtcaaacagccagttgaaaacggcggttgtcgcaggaattctgccgtttaacattgtaaaaggcattatcatcaccatcgtctttacgttcatctttacgaagctgaaaccttggattgaacaaaaacgcagcatccaaacacaataaaggcttaaagcgtccgctctgtgaagaacagccggacgctttttttgtttgtgctgatcggcaaaaaaataagactccggccgataacagccggagtcttattcaggacgaaaaagctcctctcacggggagggcttttttattcgtatttcagcgggtcgccttcgaacggttcatccgcaactttgattgaatcagtagggcatccttcaaatgcgtcaatcatatcttcttccagaacttccggaacttcgacgacacctttattttcgtcaagcgtaacgaacgcaatgccttcatcatcataatcataaatgtctggtgccgcagctccgcaggcgccgcatgcaatacacgtatctttatctacaattgtgtactttgccatgaataaaacctcccagattgttcgtgttggaacaaatggtttaccttatatatttttaaatataacacctattcctcttacttattgtaatgatgttagtgtcaaatttcaacagaaaaatgattgagaatgcttatcacataagggattctctttagcacttccccctaaaagatgactttaaacgtcaaatttatatgaaaatctgttaaaataaaaagaaccaaaaaacgaaacttgtcacaaaagaaatgtaggtgtgtttagattggcgataaactactttgataccgtggttctcgactgtctggacaaaatagacggcgaacggactccgagtgctgtgtttcatttattaaaaggaaaaaagtcgtctcaaaccattcaggatgccggcttatttcagatcgctaaatatttcggcatggcttcacagtgtgaacgcggcgatattgcggcttctatgcatagactcaccgagaactcatacatcacagccggaaaagaagagggaacgcggaaagtgactgcgcgcggcgttcaaaggcttgaacgggcgtttgctgagcggccttggccgaagcactgccacggcgcaaattatcaaacgcctgccgtcatcctgtggaggcggctttccctgctcattcaagtcctgtcaaacaaagagcatcaatgcagtcaatatatcccggttaccaacgatgtgcagacgctgagatgggtcaaatggttcatgcggaaaaacagagatgctaaagagctttccgtccaaatgcatgacgcgctgtttcagcttctgcaaggcgtaagtgaacggcaggcgcttatttttgtctattctttaacttcattcaacagaatcggcaaaacgaataagcagctcgctctccagctgaacgaagatgaatggtatgtgtccgtccagttttggggagcggtacattatgttattcaatcgcttccgcaatgtgcatatcccgctctgcgcgagctgttgtccgatctgcaggcggaaagcgcgctgacacagtctgccagaaaaacctttgagctgttggaaaaagggtttccgattgaacggatcgccgcggtcagaaatttaaaaaccgccacaatcgaagatcatatcgtagaaatatcattgcatcagcctgcattttttatagaacagtatctttctgaagaggaacagcgtatgataacggcatttgcaaaacagcatcaaacaaataaaattaaacggattcgcgaaggaatgcagatgcgcttcagctatttccagatcaggctggcgctggcaaagacggtgaatcagcatgactgagctgcataaagctttatccagatattttggtttgcattcctttaaaaaagggcaggaagagattatgactagcgtgctccaaaaaaaggatacgatcgccatgcttccgaccggcggggggaaatcattatgctatcagctcccgggttacatgatggacgggctggtgctgattatttcaccgcttctttcattaatggaagatcaggtgcagcagctgaaagcaaaaggagaaaagcgggttgcggcattaaacagcatgctgaattccgcagagcggcattttattctcagcaacatcagccggtataaatttctctatatgtctcctgaagccctttcttcaccttatgtactgaaccgtttgaaaaacgttccggtcagtttatttgttattgatgaggctcattgcatatcggaatggggacatgatttcaggcctgattattcgaagctcgggcctttcagacaggcactcggaaagccgcctgtattggcgctgactgcaacagcgacaaaagaaacgctcagagacgtgacggatgtgctcggacttgagcatgcggtgcgtcatctttattcagtcaaccggccgaatattctcctggcggcagaacatttggctgataatgccgaaaaaataaacaggctcacggagcttgccgaaaagcttgaaggccccggtatcatatattgtccgaccagaaaatgggcggaagagcttgcggctgagctgaatgaaaaaacgggaaagcggacggattattatcacggcggaatggatacaggggacagaatcttgatccagcagcaatttatccataaccagcttgattgcatctgctgtaccaatgcgttcggcatgggtgtggataagtcagatatccgctttgtcattcacttttatcctccccaaacggctgagggctttatgcaggaaatcggcagagcgggacgcgacggcagcccgagtgtcagtattttgctgagggcgcccggcgataccgagcttcagcagcagattattcagacagaaagcctgtctgattatgatctggaaggcattttggccgtcatacgggatgccggtacggatgatgagcgaaagcttcgggacgttctgatcaataaaggcgtccaggaaacacaggcgcgaacggccgtccatctgtatctgcaaggaaaaaccacaaaagagcagctgcaggaagaactgacataccgcgtggaaaagaagctgcgtaaaatgaaccgtttttcggcgttattagagcggaaagaatgtataagaaaagcgctgctgtcttattttgatgaatcgtatgagcctgaaggccaaaccggacaatgctgcagcagctgcggacttgatctggctccgtacgagcaaaaaggagaacggaaaaacatggaacggtttgaagattggaagctggaattaggccggattttcggttcagagtctgcgggtgagttcagctgagacggcaaagcgaattgatccagcagctctcagaccgggagattgtgatacagctgtatgccacccaattgctcatattggcggtttcagctgttatcggctttttctttttcaccgacattcacgattttttaaagctgtggcatatacgtgacgataatatcatatggtacggtgtaactcttgccgtccttgtcatttttgccgatctggcggtgatgaaatggtgtccttcgcatttatatgatgacggcggcattaatgtattgctttttaagaacaggccggttctgcacattttgtttttgacgcttctcatttcgttcagcgaagagattttgttcagaggcgttctgcagacacatatcggcttatgggccgccagcttcatttttaccgtgcttcatttcagatacttggcgaagtggcttctgtttatgatggttgcgggcatcagtcttttgctggggcttatctatgaatggaccggcaatttattcgttccggttacagcgcattttattattgatgcggtatttgcctgtcagatccgttttcaatatgttaggaggggtttgcatgacggaaatgtcaagagttgaaagaagaaaagctcagcagcgtgccgagcagcaggttgccgcggccgcggatgaacaaattgaatatcttgaagacagcctcccgacaagacaatctgtaaaagaggagcgtaaaaaaaaggaagagcaggtgaaggaaaaaaccaaaacaaaaacgccgctgttcacttttctgaccgtcctgttcattatcgtaacaatcggtgtctttttcggtcttctttatatgacgaacagcagcagatttgacccgaaggactatgaagatgtcttcatagaccacagtgaaagcgcgcctgccgttattccgaaaggcgctcagaaagatacgtcagaaaccgctcttttagaacaaccgaaaaaaaagtctgacgacaaagataagaaagaagcggctgcatctgaaaaaacaaaagaaaaaccaagtgaaaaaacacctgaaaaaacggaaacgtcctcagaaaaacaagtaaagccgacagacaccgaatacgcggagacaaaacagcagtctccgccggctgtccgtgaaaaagcggctccggctgccgcaagtgatcaagctgggactgtcccgaaaaaagtgcggaccgtacagcatactgtacagccgaaagaaacgctttaccgcatttcaatgaaatattataaaagccgggcgggcgaagaaaaaatccgcagctacaacggattaaacggaaacgacgtgtacaccggccaggttctgaacattccgctgtctgattaaaataaatgcatgttttcaccgcgtttttcatatagtgtactaatgaaaacggacaaggtgtgaagcgcatggattctttatggaagcaattagaccgatttgctgacggaccgacgaaacaaatgcttcaggcgctggtgaaacggaaattaaaatacgaaaattatgccgcacaatgccgaagatggcagtgggcgtccctcgtttgtttttccctgatgtgcatactgctgatgtttaaaagctttaatgccccccaagcctctccgcagctgattctgcaggaaatattaggccatacggtttatttgtgctggattatggcttccgcttttgcgtattgcacttcttattattttaaaaaaaaggaagaaaaagctgagggtgaatttcataaactgagatgtgaaattatccaaaaaagcacggatttatggccccagcctgaaaaatggagggcgagagaatctgtttttcacttgatgaaacatcggtatgatatcaatctttattttgaaagcaaataaaatgaggcgttttccggaaaggatagaaacgtctttttttgtttgtccgtctaatgtaagacaatgacagaatggagagtgcgtttatgaagctaacagcgggaattctcggctcattggcgggagcggctgcggttatggcggccgtcatgtacaaaacggcaaacggcagccatctgaaaacacatacatttacgcttgataaaatgaaagggatgaagccgctcaccatcttctttatatctgacgtgcaccgccgtttaattgatgaaaagcttctccgcgaagcggcagtttataagccggatgccgttttgctcggcggtgatttggcggagggcggagttccttacgccagaattgaagaaaacatcaaacgtctgacggctctcgcgcctgtcatttatgtgtggggaaataatgattacgaggtcagccagcaaaaattgctctcacttttacgggcatacaaagtgattccgctgagaaatgaatcggttcagtttgcttataaaggggaaaccgttacgatctgcggggtggatgatatcaggatgatgatggatgattacgaagctgcaatcagatatacggatgctgataaagtaaaccttctgctttgccataaccccgacatccatgagcagatgagggagtcagacgggattgacgctgtgttcagcggccatacgcatggcggccaaatccgtttcggccggttcgggccgtacgaattgggcggggcgggaacggtaaaaaaagcgcattatctgatcagcaacggctacgggacgacaaaagttccgctgaggctcggggcgaagccggagacgcatatgattacgctgtgcgggccggatgagccgttttcctgaaacaaatccggccgcggtgataaaaaacggcattctgcttgtcttcccgctgtacacggtgtaaactgataacaaattaagaacctatgactcatttattcatatactgtgttatatgatttgtgtgcaagaagaggcaggagggaacattatgcggcttgagcgtctgaactataataagattaaaatctttttaaccctcgacgatctgactgatcggggactgacaaaagaagacctctggaaggactcgtttaaagtccaccagttatttaaagatatgatgaatgaagcaaatacagagctcggctttgaagcgaatggtccgatcgcggtggaagtatattctcttcaggcacaaggtatggttgtgattgtaacgaaaaatcatgacgcggacgcagaagatgacgaatatgacgatgattatatcgagatgcaggtcaaacttgacgaaagcccggatattatttatcagttccattcgtttgaagatatcattcagcttgccggaagccttcaccgcatcgggattaccggcggcaccgtctaccattatgagaaccaatactatgtaagccttgaagacctcggctcccgttccgccgaaggtgtcatcgcggtgctggctgaatacggacacccggcgacaattacgatttacaggctccatgagtacggaaaactcatcatggacggcaatgctgtggaaaccatccagaaacatttttcataaaaaagatttgaaacggcagctgttttcagcggccgtctttttttaagcgaaataatggaaaaatcattgtctttcttctatgcacggagatattgaaggtgtatactagtcactgaaagggagcatgagagaaacagaagattttaggaggttaactcaaatggcagccgatcgattcaccggtcataatgaagaagacaaacatgatgtattaaaatcaacccaaaccgtaatacataaagctctggaaaaattggggtatccagaagaagtgtatgaactgctgaaagagccgctcagattattaacggttaaaattcctgttcggatggatgacgggtctgtgaaaatatttacaggctatcgtgcgcagcacaatgattccgtaggtccgacaaaaggcggcattcgttttcacccgaatgtaactgaaaaagaggtgaaagcactttccatctggatgagtttaaaatgcggaattattgatcttccttatggcggtggtaaaggcggaattgtttgtgatccgagaaatatgtcattcagagagcttgaaaggctgagcaggggatatgtaagagcaatcagtcagattgtcggaccgactaaagacgtcccggcacctgacgtatttacaaactcacagattatggcttggatgatggatgaatattcaagaattgatgaatttaactcacccggctttattacgggaaaaccgcttgtactcggcggatcccacggcagggaatcagcgacggcaaaaggcgtcaccatctgcataaaagaagcggctaagaaaaaaggtctcgatattcagaacgcgcgtgtcgtcgtacaaggtttcggaaatgcgggcagctatctggccaagtttatgcatgacgccggcgcgaaagttgtcggaatttctgacgcgtacggaggcctttacgatccggacggtcttgatattgattatctgcttgaccgcagagacagcttcggaacggtgacgaagcttttcaatgacaccattacgaatcaggagctgcttgagctggactgtgatatacttgtcccggcggcgatcgaaaaccaaattacagaagaaaacgctgaccgcatcaaagcgaaaatcgtggtagaagcggcaaacggaccgacgacactggaaggaacgaaaatcctgacagacaaaggaacgctgctggttcccgatgttctggcgagcgccggcggtgtaacggtttcttatttcgaatgggttcaaaacaaccagggcttctactggagtgaagaagaagtcgaggaaaaactggaaaatatgatgataaaatcgtttaataatatttatgaaatgtcccaaaaccgccggattgacatgaggcttgcggcttacatggtcggcgtgcggaaaatggctgaggcttcgcgtttcagaggctggatataaaccaatcgtttgcataaacaaaaaaaatctcctatgataatataggagattttttatatgagtggaaacttatgatggaaatgccaatcgcaggagttgaaggacatgacagaagaaaaagcaattataataggcggaggtccttgcggattatcggcggctatacatctgaagcaaattggcgtgaacgcgcttgtgatcgaaaaagggaatgtcgtaaacagcatttataactatccgacgcaccaaacttttttcagttcaagtgaaaaattggagatcggcgatgtcgcctttattacggaaaacagaaaaccggtccgaatacaggctctctcttactacagagaggttgtcagaagaaaagagctgcgcgtaaacgcctttgaaacggtggagcgcgtaacgaaacaggaagacggccgttttcttgtagaaacgtcaaaagaccgctacctcactccgttttgtatcattgcgacaggatattatgatcatccgaattatatgaacataccgggtgaagggcttcctaaggtatttcattactttaaagaaggccatccttattttgataaagatgttgctgtgatcggcgggaaaaactcaagtgtggacgcggctttggaactcgtgaagtccggtgcgcgcgtcacggtgctctacagaggacatgagtattccccgagcatcaagccgtggattctgcctgagtttgaggcccttgtcagaaacggcacaatccggatggaattcggcgcttgtcttgaagaagtgacggaagatgaaatcattttccgctccggccgaaatgagacggtccggctgaaaaacgatttcgtatttgccatgacgggataccatcccgatcacggtttcctcgaaaaaatcggtgtgcagattgatgctgaatcaggccggccgtttttccgggaagaaacgatggaaacaaatgttgacggtgtttttatcgccggagtcattgcggctggaaataacgccaatgaaatttttatcgagaacggccgttttcacggcggcttgatcgcaaacgaaatatcaaaacggctgggtgcagagagcatatgatcattcatatgctcttttttaaaaaattgaaagatgtaaaaatatgaacaacatggtaccatagatataggaatataaaggaaagaggttgcctgatgtttgcaatcatctctgcaggaattgctcccggcattgcgctgttaagctatttttatttaaaagatcagtatgacaatgaacctgtacatatggtgctgaggtctttttttctcggggttgtccttgtgtttccgaccatgtttatccaatatgttcttgaaaaagagcatgtggggggaggaagctttttcgtttcgtttttgtcttcgggatttttggaagaatcggtgaaatggttcgttctgatgatcagtgtgtacccgcatgctcattttgatgagcattatgacggaatcgtttacggggccagtgtgtctttaggctttgccacgcttgaaaatattctgtatttattcggccacggcgttgagcatgcttttataagagcgcttctgccggtctcctgccatgcgctgatcggagtgattatgggattttatctcggaaaagcccgcttttcgcagaaaaaagcccgtgtcaaatggcttgtgatttcgctggccgtgccttcatgtctgcacggttcttacgattttattcttaccgccctcaatcattgggtatattatatgctgccgtttatgctgtttttatggtggttcgggctgcgaaaggcaaaaaaagcacgctccgtcaatatgatccaagtgtgaagaaaccgcgcatcgcgtgcggtttctttttttatgccttgatgagggataagaaggaaacggtgtataaaaatatccgcgtgacagacaatacgggtacactttaaattttgcagtaggaggcttgaagagatgaagtgcaaaggagcctttatggcatgtctcattctattttctttcgccgccgctttcttcgatcatcatgaaacggttcatgcgttttcaaatcaagtgattcaaagaggcgcgacgggtgatgatgttatagaattgcaggcccgtcttcaatataacggattttataacgggaaaatcgatggtgtttacggctggaccacatactgggccgtgagaaattttcaggagaaattcggcatgaagccggttgacggcctcgtcggggcgaaaaccaaacaggtgctgatttcaaaatcaaaatattaccgtgaatatgtaatggagcagatccaaaaagggaatacgttcactcattatggcaacgtcccattggaaaaccaaacaaaaccgagagccggagcgcagaagcctgcggaaacgaataagcctgctcaaaagccgcaaaacaatacaggcggtcagtcaaatcaaaagcaaaatacgacagcggctaatatgcctggcggtttctcaaacaacgacatcaatcttctggcgcaggctgtgtacggggaagcgcgcggtgagccgtttgaaggacaggttgccattgccgcggttattttaaaccgtattaaaagcccgttatttccgaatacggtggccggcgtcattttcgaaccgctcgcgtttaccgccgttgccgacggccaaatatacatgcagccgaatgaaagagcaaaagaagcggttcttgatgcgattaacggatgggacccttctgaaaacgcgctttattatttcaatcctgatacggcgacaagcaaatggatttggggacgtccgcagattaaaagaatcggaaagcacattttctgtgagtaaaagtacgcaaaatgaggtgttaacatgattagaggaatcattatcgctgttctcggtgtcgcgatcgccgcaaccggatactggggatataaagagcatcaggaaaaagatgcggtccttctgcacgcggaaaataattatcagagggcttttcatgaactgacgtaccatgttgatcagcttcacgacaaaatcgggacgacgcttgcgatgaacagtaaaaaatctctgtctccggcgctcattgatgtatggagaattacatctgaagcgcataacaatgtgagccagctgcccctgactctcatgccttttaataagacggaggagtttttatccaatataggagatttcagctataaaacatccgtccgggatttagaccaaaaaccgcttgataagaaagaatatacaacactgaacagcctgtacaaacaggcggagaacattcaaaaccagcttcgcagcgttcagcatctcgtcatgagcaaaaatttacggtggatggatgttgaaatggcgctcgcctctgacaaaaaacaaagcgataatacgatcgtcgacagctttaaaacagtcgaaaaaaatgtaggcgctttttctgaagacagcatcagccccacatttacgggagcaaatacagaacgaaaaggttttacgcatctgaaaggaaaacaaattacggaaaaagaagcggtaaaaatcgcacaacggtttgcgcctgatcataattattccattaaagtggtcaaaagcggccggaagacgaatcgcgatgtatacagtatccgcatgaatgacgcggatcacaaatcttttatctatatggatattacccaaaaagggggacatcctgtctatttgattcaaaaacgggccgtgaagaaacaaaagatcagcctcaatgaagcatctaaccgggctgtcgcgtttttaaagaaaaacggatatgaaacaaaaggtctcgaaattgatgaaagcgcgcaatataataacatcggcgtcttttcttttattcccgtggagaaaaacgtccgcatttatccggaagccatccgaatgaaagtggcgctggatgatggtgaagtcgtcggtttttccgcgcgtgattacctggcggcgcaccgcacgagaacgattccggctcccgctttgtcagctgatgaagcgaaagcgaagctgaataaaaatgttgaagtgcgggagacccggcaggcgctgatcacgaatgaactcggtcaggaagtgctttgctacgaaatgctcgggacgatcgggaaagacacgtatcaaatgttcattaatgcggacgacggaaaagaggaaaaaatagaaaaattaaaaagcgcagagcctatatataaagacctataaaaataaaggaggaaaggactaaaagtcttttcctttttttcattacatgctttaataaaagcataaataatgaaagagtgaaggccatgatagctgtcggagattatatttggattgaatacatagagaacaatgagcccaaaaaagcgaggagtaaagcagtaagcgttgaaaacggcgaactccacatctcatatcccgtcgatctggattcgggacggacggtctttttgcataaaggattggaaataacagcggaatttatggggaatggccaagtaccgtatcaatttaaaagcataattaaaggaaagaaaaaagaacccatcccgatgatcggattggacatccccctcaggaggaaatgaagcggattcaaagacgccgatacgtccgtgcagacgcagtattggatgtatccgtcaaattggaagcgaaaaaaaccgcttttcaaacggtttcctctaatatcagcgccggcggaatcgctgttgtgatgcctgagcatatttccgcggaaccaggtgaaaagctgtatgtctcattttctcttcccggcaaggaaaatggggcggatataacggccgaggctcttacccagcggattttttatgatgaaaaggcggataaacaaaaaatgacgcttgaatttacagaaatcggccccgcagcacagcagcttttactccaatattgtatgcgcgcgcagctgcagcagagaagaaacagtctgtcggaataaacagcagcgcacttttccatactaatcctaatggaggtgcgcgtgtatgaaaacatttgaacgtctgctggtcaaattggtctgcattcagcttataattttgggcgcggtgcagtttttgcttcattatcagcctattgaaccttatatttcgaaagctgtgaaatatgagggagttgataaaatggagaaaaaagaatggattgaaacggtaaagcggtaaatcagctcaattttttcgccccttttccggcagttcatgatacaatccatagaggagtaaagagcaaggagagagattatggacaagaaattatcaattgcgatcgacgggccggccgctgccggaaaaagcaccgttgctaaaatagtagctgagaaaaaatcatatgtgtacattgatacaggggcgatgtatcgtgccattacatatacggcactcaagcagaatgccgatttaaccgatgaagccgcgcttacagagcttttgaagcgtacggaaattgagcttgtatccgctccggaaagacaaatcgttctcgtaaacggagaagatgtgacagaagaaatccgaaaagacgaagtcagcaaccaagtatccatcgccgccaagcataaaggcgtcagagaagaaatggtcaaaagacagcagcagctcggacaaaaaggcggtgtcgtcatggacggccgtgatatcggtactcacgtgctgcctgatgccgaagtgaaaatttttctgctcgcgtccgtagaggaaagagcgaagcgccgatatgaagagaataagaaaaaaggctatgacgtgaattacgagacgctcattgaagaaattgccagacgcgacaaactcgattcagagagggaagtttccccgctgcgcaaagcggaagacgcgattgaaatcgatacgacgtcactcagcattgccgaagtcgcaggaaaaattctggagatcgtcgaacagaaatcacgttaacttcgggcggagcgctttttaatttttttcaaaagacaagatgttattgcttgacaaaccagtccttttattagaagttaatactaataaaactttttattgatcattcaaaatcttttttggatgattctttaatacatattcggctgaaaagcggacattcacatgttcagctttcaaaccgtattaattaagctgtgtaggtttggaccaaggaggttattcaaatgacagaggaaatgaatcaaattgatgttcaagtgccagaggttggagatgtagtaaaagggattgtgacaaaggtagaggacaagcatgtagatgtcgaaattgtcaatgtcaaacagtccggaatcattccaatcagtgaattatcaagtcttcatgtagagaaagcatcggatgtcgtaaaagttgacgacgagcttgacctgaaagtaacaaaagtggaagacgatgctttgattttatctaaacgtgccgttgatgctgaccgcgcttgggaagaccttgaaaaaaaattcgacacaaaagaagtgtttgaagctgaagtgaaagatgtggtgaaaggcggtctcgtcgttgatatcggcgttcgcggcttcattcccgcatcacttgtcgaagctcatttcgtcgaggatttcactgactataaagggaaaaccctctctcttatcgtcgttgaactcgaccgtgataaaaaccgggtgattctgtcacaccgggctgtagtggaaaaagagcagacagccaaaaagcatgattttctccaaacgcttgaggttggaagcgtgcttgaaggaaaagtgcagcgtctgactgatttcggcgcatttgtcgacatcggcggaattgacgggcttgttcatatttcgcagctgtctcattcacacgtcgaaaaaccgtctgacgtggtggaagaaggtcaggacgtaaaagtgaaagtgctgtccgtagaccgcgataacgagcgtatttctttatctattaaagaaacgctgccgggaccttggagccagatcggcgaaaaggtaaaacagggagatgtgcttgaaggaaaagtgcagcgccttgtaagcttcggcgccttcgttgaaattcttccgggcgtggaaggacttgtgcacatttcgcaaatttccaataaacatatcggaacgccgcatgaagtgcttgaagaaggacagactgttaaagtgaaagtgcttgacgtgaacgaaagcgaagagcgcatttccttaagcatgcgtgagcttgaagaagcgccgaaagccgatcaggaggacttccgtcaataccaggcgaaagaagagccgagcaccggcttccagcttggcgatttaatcggagacaagcttaataaattaaaataaattggtgataaaacgtgacacgagcagaacgaaaaagagaacatataaatcatgcgctgtctaccggccaaaaccgggaaacggggcttgatgatattacgtttgttcatgtcagcctaccgaacctagcattggaaaaagtggatatatcaacgaaaatcggcggactcacaagcagttcgccgatttttatcaatgcgatgacaggcggcggcggacagcttacatacgaaattaacagatcgctggcaagagccgcgcgcaaagccggcatgccgctggctgtcggttcgcaaatgtcggctttaaaagatccctccgaacggtattcttacgagatcgtcagaaaagagaatccggacgggctgatatttgccaatttaggcagcgaggcggatgccgagcaggcaaaaagagcaattgatatgattcaagcggatgccctccagattcatttaaatgtgattcaggagatcgtcatgccggagggagacagaagctttaccggcgctctcggccgtattgagcggattgcggcggaagcgggagttcccgtttttgtcaaagaagtcggcttcggaatgagcagggagtcggcacggcagttatttgatgccggtgcggcagcagttgatgccggcggatacggcggtacaaatttctctaagattgaaaatatgcgcagagagaaggcgcttcaattttttaatacatggggaatttccactgccgcaagcttagcggaaatccactcgctctccgctgatcaatcaattatcgcatccggcgggctgcaaagtgccctggatgtcgccaaatcgattgccctcggcgcttctggcgcgggaatggcaggcactttcctgaaagctctcacctccaaaggagaagaggggctgtttgacgagatgacggtgcttttacaagagctgaaaatgattatgaccgccctcggatgccaatcggttgcccaattgcaaaaggcgcctttggtcataaaaggtgacacacatcactggctttctgaacggggaattgacacatcccgtttcagcagacgttaaaaggcatgcgaacccgcatgcctttctctgttttttacgattttctttttcggaattcaccgttttgttcaaggctcgtcgctcctttatggtgaattgaatcatcgcgatcagattccacccggcgggaggctttcagttttttctcctgtctgtcttttcccatttttatccgctcctttcaggcataattggtttaaaaaatgcgttcccgctccatactggtcagaggaggagcgattatggaaccgttttattattactggtcaatgtggtttttatggatacttgcgacttttatttttgccaaaacaaaaagccgtttttacgtatcagtctttattttgactaatatgatggcaagcatacatcagataacggcttattttacgctgaacgcggcatatgtcatgttttttgctgcggcatttgtttatgcgggaagcctcggcatgcataaacggctccgtcatattgtgattcatctgacggcggctgcggcgtacggctttatttttctttttgcattatatgaccctgtttggtttatcataaaacctgaatgggcagcggttatactgcttaccgttattacgctttctgttgaggggcggttccctgagaggctttgtctttttgttctcggcatgtgccagggggagttattgtatgctgcggtcatccgcaacattgcgggggcagcagccgtcggtgattataaatggctatcaggctgttcggcgggagtgattcttctcgtcgggctgactacatatgaacagcttgcggcgcgcatcagccaaaaaagcaaaaagcagggcaaaggagcgacaaaaatgtcttgaaaacagacggagactgttacatgaatacgaaacattttgaagaatacattgtgatctcagtgaaaactgatataataaatgagttaagcccttctgtttgaagggttcttttcatagcgaagatgattattaataaccggttgaacaattttttgtgaaaatgtaagcggctggattgaaaggaagggtactatgggtaaacctgtcgtagccattgtcggaagaccgaatgtgggaaaatccacaatctttaaccggattgcgggtgaaagaatttcaatagtagaagatacccccggagtgacgcgggaccggatatacagttcggcggaatggctgaattatgattttaacctgattgatacgggcggaattgatatcggagacgagccgtttctgacacagatccgccagcaggctgaaatcgccatggacgaggctgatgtgatcatctttatggtgaacggccgcgaaggtgtgacgtctgcggatgaagaagtggcaaaaatactgtaccggacgaaaaaaccggtcgtattagccgttaataaattagataataccgaaatgagagcgaacatttatgacttttatgcgctcggctttggagaaccgtatccgatttcggggacacacggtttaggattgggagatttgctcgatgcttgtgccgagcattttaaaaacattccggagacgaagtacagtgatgatgtcgttcaattctgcctgatcggccgcccgaatgtcggaaaatcatcccttgtcaatgcgatgctcggcgaagagcgggttatcgtgagcaacgtagccggaacgactagagacgctgtggatacggcgttcacttacaatcagcaggaatttgtaatcgttgacacggcgggaatgagaaaaaagggtaaagtatatgaaacaacagaaaaatacagtgtgctgcgggcgttaaaagccattgaccgctcagacgtcgtcggcgttgtgctgaatgcagaagaaggcatccttgagcaggacaagcggatcgccggatacgcccatgaagccgggaaagccgtcgtcattatcgtaaacaaatgggatgccgttgataaggacgagcgcacgatgaaagaatttgaacagaatattcgggagcatttccaatttctcgattatgcgccggtgctgtttatgtcggcactgacgacaaagcggattcatacactcatgcctgcgattattaaagcgagtgaaaaccactctctccgtgtgcagacaaatgtcttaaatgatgtcatcatggatgcggtcgccatgaatccgactccgacgcacaacggctcccgtctgaaaatttattatgcgactcaagtcgctgttaagccgccgagcttcgttgtttttgtcaacgatccggaactgatgcatttttcttatgaacgctttttagaaaaccgaatccgggacgctttcggatttgaaggtacgccaattaaaatatttgcaagagcaagaaaataaaaaggtgtgatacagagatgaaaaaagtggcaatgcttggagcgggaagctggggcactgcactttctttagtgctggctgataacggacatcaagtcatgatgtggggacaccgtgccgaattgatcgatcaaatcaacgaactgcatgaaaacaaagattacctgccgggtgtggagctatcaagttctatcatcgggacagccgatttaagcgaggctttaaaaggagctgacttcatcattgtggcagtaccgacaaaagccattcgggaagtgctgaaaaaggctctgccgtatatcccgaaacaatcgatttttgttcatgtcagcaagggaattgagccggattcgcttctccgcatttcagaattaatggaggaggagctgcctgaggagtacagaaaagacatcgtcgtgctttcagggccgagccacgctgaggaagtcggattaagacacccgacgactgttacatcatcttcaaaaaatatcaaggctgcagaagcggttcaggatttattcatgaaccagcatttccgcgtctatacaaatcccgatatgatcggtgttgaaatagggggagcgttaaaaaatatcatcgctcttgcagcggggattacagacggattgggatacggagataatgcaaaagcggccttaatcacccgaggtcttgctgaaatcgccagactcggcacaaagatgggcggaaatccgctcaccttttccggcctgaccggcgtaggcgatttaatcgtgacgtgtacaagcgttcattcccgaaactggcgcgccggcaacctgctcggcaaaggatataagctggaagctgtcctggataagatggggatggttgttgaaggcgtgcggacgacgaaagctgcgtatcagctgtctcaaaaatatcaggtgaaaatgccgatcacagaagcgcttcaccaagtattatttaatgggcagaaggtagaaacggccgtagaatccttaatggccagagtgaaaacccatgagatggaagacttggtcaacacattcgaaaaccgggtgaagtgacaataacatgccgtcagcatattctgaagtgacgaaagtccaaaacgcagaactctccggctgaaatcgcttaaaacatttgctgatttaggcagaagaggatgcagacgtacgcatctacgcatactatagcatcgaagtccaagagagtgtatctcagacgtacaggtgaatatagtcaacttgactgaagcaaagtccccctctttgcttcagttttttgttttttcaatagatggaaaacctgttgatcttttcaacatttgtatattaaaatgaaatataacgcttacaatgatgggacggggggcacgaacgtgagtgtggcattgatgaaaatgtggtttgcgcttggtgctatgggattaatgtttgttgcggtcgcctttatttatgtcagcaggtacaaagtgaaaaacaaactgataaaagcagcggtttcttcactcgcttatgcctgcatggtcatctcgggattgatcgtgttaatggtcgttttcagcgggcctgtcaatgaataaagccaaaagggggcgcggaatgcataagttaaaaatggccgtcataacggcaatggcggtgcttctgctgtcgggctgtctgtaccctgaagcaaaaaaaactgaaaataaagtatcttacaaacatcagcttcagcaggtgcaagcggcagtggatgaatttaaaaaggcgaacggcggacttctgccgattcagacaaaagatatgaaaacaccgctctatcaaaaatatccgatagattttaagcggctcgcgcccagatacatagaggagccgccggcctcagcttatgaaagcggaggaatgtaccaatacgtgcttgtcgatgtggaaaataagcctaccgtcaagctggtcgatctccaaatggcggaagcaatccgcgacatgaagctgcgtgtcaaaatgtatcaggaaaagcatacatatcctccctatgaggacgctgtttcaaaaggcctgttcactttaaataaaaaaaagctcggcatgaaagactctccttcagtcaaaagtccggtttcaggcacgtctctgccgcttttaatcggcgctgacggagaaatctatgccgactatcgcgtcgatctcgcccgctgcctgaaggaaaacaaaaagaaaatcaaaccgggcgcggaaattcaggatattttatggaaagagactcctttcgtcccggccttttcagtcacttacaccgtaaatgaaaaacaggaacccgtttttttagaaagtcaaacgaaacaggaatgaacctttttcccgcgcatacaaatagggagaaaggtttttttgattttgatagaaaagactgcctgaaaattttctaaagatgtcatattgaaataggacaacgtcatacacatatagtgtcctgtatttgattggagaatggtgaatgaaaaatgataaggataggaagtccgggaggggatcacttggaaaaggtcgatattttcaaggatatcgctgaacgaacaggaggcgatatatacttaggagtcgttggcgctgtccgtacagggaaatctacattcattaaaaaatttatggagcttgtggtgctcccgaatatcagcaatgaggccgaccgagcgcgggcgcaggatgagcttccgcaaagcgcagcaggaaaaacgataatgaccacagaaccaaaatttgtcccgaatcaagccatgtccgttcatgtcgcggaaggacttgatgtcaacatccgtcttgtggattgtgtgggatatacggttcccggggcgaagggatatgaggatgaaaacggtccgagaatgatcaatacaccttggtatgaagaaccgattccctttcatgaggctgcggaaatcggtacgagaaaagtcatccaggaacactccacaatcggggtcgtcattacgacagacggctcaatcggcgatattgcgcggggcgattacgtggaagcggaagaaagagtcatcgacgagctgaaggaagtcggcaaaccgtttattatggtcatcaactcggtaaaaccgtaccacccggaaacagaagcgctcagagctgaattaagcgcgaaatatgatattcccgtcctcgccatgagtgttgaaagcatgcgggaaacagatgtgttaagcgtcctcagagaagcgctttacgagttccctgtgctggaagtcaatgtcaaccttccgagctgggtcatggtgctgaaagaaaatcattggctcagagagagctaccaggaatcagtgaaagaaaccgtaaaagatattaaacgcctgcgcgatgtcgaccgggttgtcggccacttcagtgaatttgagtttattgaaagcgccggattggccggaatcgaacttggccagggtgtcgcagaaattgatttgtatgcgccggatcatttatatgaccagattttaaaagaagtggtcggcgttgaaatccgcgggaaagaccacctgcttgaattaatgcaggacttcgcccacgcgaaaaaagaatatgatcaggtatcagatgcgctgaaaatggtgaaacagaccggctacggcattgccgccccggccttaaccgatatgagccttgatgaaccggaaatcatcaggcagggatcaaggttcggagtaaggctgaaagcggtcgctccgtccattcatatgatcaaagtggatgtggaaagtgaattcgcaccgatcatcgggacagaaaaacaaagtgaagagcttgtccgctacttaatgcaggactttgaagatgatccgctttctatctggaattccgatattttcggcagatcattgagctctatcgtaagagaaggaatctccgcaaaactgtcactcatgccggaaaatgcgagatacaaactgaaagaaacgctggagagaattattaacgaaggctcaggcggcctgatcgccattattttgtaagctgaaggacctcttcctgaaacggggggtctttttttattctttttagatactggaaatcaatcaaggattaggaggaaaaaagcaaaaaaaggaatatttgttcggtaaaacacgtgaaaaccttgacgagcaagggattgaggctttaaaatgcttgatatggctttttatatgtgttactctacatacagaaaatcttcactttgttggacaaacattcctcaaagtgtctgttttcttatgaaaagccgtttacttgtctgttcttccctgctttgattttttatcagacaggtttagaatcaggctgaactgtgaagaaatgataataaactgctgatttgatacccttttgggaggaggtgaaaggcatgaacaagacagaactaatcaatgcggttgctgaagcaagcgaattgtctaaaaaagacgctacaaaagcagttgattctgtttttgatacgattttagatgcacttaaaaacggtgataaaatccaactgatcggtttcggtaactttgaggtgcgcgagcgttctgcacgtaaaggacgtaacccgcaaacgggtgaagaaatcgaaatccctgcaagcaaggtacctgctttcaaaccaggtaaagctcttaaagacgctgttgcaggaaaataattgtgaatatagatcgtgtatgcatctgatacatacactttgtttcttcacagaaaagccccttgataaaggggcttttcatatttaagcagccccggtcaccgggcaggactttcgttttgcttttggcgcggcaaatgtgctagaatcgaaattaaatgtattcaatggtggaggacacagacaatgaaagaagttaataaagaacagattgaacaggcggttcgccagattttagaggcgattggagaagatccggaccgggaagggcttttagatacgccgaaacgcgtggcaaaaatgtacgcggaagtattctcgggattaaatgaagacccgaaagaacactttaaaaccgttttcggagaagagcatgaggagcttgttcttgtaaaagatatcgcgtttcattccatgtgtgaacatcaccttgttcctttttacggaaaagcgcatattgcctacattccgcgcggcggcaaagtgacgggcctgagtaaattggcgcgggcggtggaagccgtctcaaaacgcccgcagctgcaggagcgcattacttcaacgattgcagaaagcatcgtagagaccttagatccccacggcgtcatggttgtcgtcgaagctgagcatatgtgcatgacgatgaggggcgtaagaaagcctggcgcaaaaacagtgacttccgctgtaagaggtatttttaaagatgacgcagcggcgcgttccgaagtgttagaacatattaaacgtgcggattaataatgatagagggtgcagatatgaattcaaagcattcaagtgattttgtcgtcattaaagcggtcgaggacggcgtgaacgtcatcggtttaacgagaggtacggatacgaaatttcaccattccgaaaaactggacaaaggcgaagtgattatcgctcagtttactgagcatacctctgccatcaaagtgagaggcaacgccctcatccagaccgcttacggagaaatgaacagcgaaaaaaaataagccggctgtttcccgcttttgccaattgcccgcaaacggcgggagaatacagccaatttcttttttttatgctataatgatacctgcgtataataatgacgagtaaatctcatacatattagaataaatgtgaatttggggacaagggtgatatttttgcaagacatctacggaactttaacgaatctaaatacgaaattaaaacaaaagctgtctcatccttatttagcgaaacatatttccgcgcctaaaatcgatgaggataagcttcttctttttcacgctttgtttgaagaggcggacattaagaacaacgacagagaaaattacatagtaactgcgatgcttgtccaaagcgcccttgatacccacgatgaagtgacaacagccagagcgttaaagcgagacgaaaataaaaaccggcagctcaccgtgcttgccggcgactatttcagcggactgtattattcgcttttatctgaaatgaaggatatctatatgattcggacgctcgctacggcaattaaagaaatcaatgagcataaaatccgtctgtacgatcggtctgtcaatgacttgaatcaattgatcgaaagcatggcgattgtggaagcggccctgtttcacagagtgtcagaccactttaatcttccgcgctggaaagagctggcgagtgatttttttgtatataagcggctgatgaacggcaatgctatatttctcgatgtcatcggcaatattgtaaagtcagggaaatcaaaggctgacataatggaagatagcttccgaaaggcaaagcaaagcattgaaacgctgctgccgctcaattcaccaatccaaaacctcatgctgaaccggctcaaagcgatcagccaggacaaaacatatcatcagaaagtggaagaagggtaatcaacatgcaggagtcaaaagaacagcgcgtacacggcgtgtttgaaaaaatctataaaaattatgaccaaatgaactctgttatcagttttcagcagcataaaaaatggcgcgataaaacgatgcagatcatgaatgtaaaagaaggcgcaaaagcgcttgatgtctgctgcggaacggctgactggacgattgccctcgcagaagcagccggaaaaagcggcgaaatcaaaggactggatttcagcaaaaatatgctgagcatcggcgagaaaaaagtgaaagagggcggttacagccaaattgagcttttgcacggaaatgcgatggagcttcccttcgctgatgattcttttgattttgtcaccatcggcttcgggctgcggaacgttcccgactatctgaccgtgctgaaagaaatgcggcgggtcgtcaaaccgggcgggcaggttgtatgtctggaaacatcccagccggaaatgttcggattcagacaggcatattttctatattttaaatacatcatgcctttcttcggaaaaatgtttgcgaagagctataaagaatattcttggcttcaagaatcggcaagagaatttcccggtatgaaagagcttgcgcgtctgtttgaagaagcgggcctgacgaatgtcaaataccattcgtttaccggcggagtggccgctacgcatatcggttggaaatgatgaatatacagatgtttgggtgaatgatatgaaatttaaaatggcctattcttttttaaatgacgatattgatgtgatcgaaagggaacttgagcaaacggtgcggtcagactatcccttgctgagtgaagccgggctccatctgctccaggcgggaggcaagcggatccgccctgttttcgtattgctttccggcatgttcggcgactatgacattaataaaataaaatatgttgcggtgacgctggaaatgattcatatggcgtccctcgtgcatgacgacgtcattgatgacgccgagctgcggaggggaaaaccgaccatcaaagccaagtgggacaaccgtatcgccatgtataccggtgattatatgcttgcgggctcacttgagatgatgacgagattggatgagccgaaagcccaccggatcctgtccaaaaccatcgtagaagtatgcctcggagaaattgaacagatcagagataaatacaatatggaacaaaacctcagaacctatttgcgccgcatcaaacggaaaacggctcttctcattgccgtcagctgccagctcggcgccatcgcttcgggagctgatgagaagattcacaaagcattatattggttcggctattacgtgggcatgtcctaccagattattgacgacattcttgatttcacttcaacggaagaggaactgggaaagccggtcggaggggatctgctgcaaggaaatgtcactctgcccgttttgtacgcgctccgtcagcctgaattgaaaaatcagctgaaattaattaacagtgaaacaacacaggagcagctcgcccccattattgaaaatattaaacgcacagacgcaattgaaaaatcaatggccgtcagtgacaggtacttaaaaaaagcgtttgaaaaactgaatacactgccgagaggacgggcgcgctcatcattggccgccatcgccaaatatatcggcaaacggaaattttaaattccttttacgaacaagatgtgaacattctccgccctggattgattaattgtcagaaagatgttacgatttcggtgtgcaacttgaaagcctatacataatgatggggtggagaatcttatggaaaaaacttttatcatggtaaaaccggacggcgtacagcgccagctgatcggagagattttatccagatttgagcgtaagggcttacaattggcaggagccaagctaatgcaagtttcagaacagatggctgaaaaccattatgctgaacataaagggaagccgtttttcggcgagcttgtggaattcattacatcaggacccgtatttgcaatggtatgggaaggggaaaatgtagtagagatcacaagacagctgatcggaaaaacgaacccgaaagatgcactgccgggcacgatccgcggtgactacggcatgtttgtcggcaaaaatatcattcacggttcagactccttagaaagcgccgagcgggaaattgacattttcttcaaacgggaagagcttgtaccgtatcaaaaattaatggccgactgggtgtactaagccgtcagcctttctttttctcttgttatgaaaaggtttacatattttaagaaagacagaggctgcgctgccctgtcttttcatttctcacaaatcagcctgcgggctgatttttttattgaaatcgtacaaattagaaagaaaacaggctatactaggacaaaagacagcgagattgggagagaagcaatggagccttacgaaatttttatcaccaagtggaaacaaataaccggcgttgatttatctttatacaaagaagcacagatgaaaaggcggctgacgtccctttatgaaaaaaagggattcaaagattttcaggaatttgccgccgctttggagaaagacaagcttttattaaatgaaacattggacaggatgacgatcaatgtttctgaattttaccgaaattataaacggtgggaagttcttgaaacctcaattcttccgttaataaagcataacaaaccgttaaaaatatggagtgcggcctgttcaacgggggaggaaccctatactttggctatgattctcagtcagcaggcgggtttggccggatttgatatattggcgacagatattgatgaaaaggcgcttggcaaagccaagcggggcatctatcaggaacgctcgctgcaagaggtgccggcttccgtgaaaagccgttatttcaccaagcaggctgacaacagttatcaagtaaaacaagagattcaaaaaaacatccggtttaagcggcacaatctgctcgccgacagctatgaacaggattttgatctgatcgtctgccgcaacgtctttatttattttactgaaaaagcaaaagaagagctgtatgtaaaaatggcgggcagcctgaaaaagaacggaattctgtttgtcggaagcacagagcagattttcagcccggaaaaattcggccttgagagcactgatacatttttttatcaaaaaagatagaagacatttaatgaaaacttgtggtatagttttacttaaaagcgttaatgcgatgaagggagaagaaagaaatgagatacttaacagccggagaatcacacggcccgcagctgacgacaattatagaaggtgtgcctgcggggctttatataactgaagaagacattaattttgagcttgccagacgtcaaaaagggcacggccgcggacgccgcatgcagattgaaacggacagggcgaagatcacaagcggcgtgcggcatgcccggacactcggttcacccatcgcgctcgttgtagagaataaagattggactcactggacaaaaatcatgggcgccgcaccgattacagaagaagaagaaagtgaaatgaaacgtcagatttcaagaccgagaccgggacacgcagatttgaacggggctattaagtataatcaccgtgatatgagaaatgtgttagaacgatcttccgcgcgtgagacaacggttcgcgtggctgccggagccgtcgctaaaaagattttagcggagcttggcattaaagtcgccggacacgtcctgcaaattggcagcgtaaaagcagagaaaaccgattacacatccattgaggatctcaaacgggtaacggaagaatcaccggtgagatgctacgatgaagaagcaggccgtcaaatgatggcagccattgatgaagcgaaggcaaacggcgactcgatcggcggaatcgttgaagtgatcgtcgaaggtatgcctgtcggtgtcggaagttatgtccactatgaccgtaagctggacagcaagctcgctgcagccgttctgtcgattaacgcgtttaaaggcgtagagttcggcatcggttttgaagcggccggcaaaaacggcagtgaagttcatgatgaaatcgtatgggatgaagagaaaggctatacacgcgccacaaacaggctcggaggattagaaggcggtatgacgacgggaatgccgattgtcgtccgcggcgtcatgaaaccgatccctactttgtataagccgctgaaaagcgtcgacattgaaactaaagaaccatttacagcgagcattgaacgttcagacagctgcgcggttccggcagcaagtgtagtggctgaagctgcagtggcctgggaaatcgcaaatgccgtcgtagaacaattcgggcttgaccagatcgaccgcattaaagaaaatgttgaaaacatgaaaaaactatcgagggaattctgatgaaagagcttgaggttcggacagcttcctccgcatatcccgtgtatatcggtgaaggcataaggaaacaggccgctgctcttttgtcttcactgaacaggccgctgacaaagatccttctcgtcatcgatgctgaagttgaccggctttacggcgatgagatgttccggcttttaaacgaaacatggcccgtgaaaaaagtaatcgttccaagcggagaagaagcgaagtctctaaaagagtatgaacggattcaaacggaagcgatcgctttccatatggaccgctcctcatgtatgatcgccttcggaggcggcgtgacgggtgatttgaccggcttttgcgcagcgacttttatgcgaggaattgatttcattcaaatgccgacgacactgcttgcccatgacagcgcggtcggcggcaaggtggccgtcaaccataaactcggaaagaacttaatcggcgcgttttatcagccgaaagcggtgatttacgatacggagcttctgaaaaccctgccggaacaagagctgagatcgggcatggctgaagtgatcaaacacgcgtttatcgccgatcatgcttttttagaaaaacttctcacgtttgacacgttgcaaggactgacaagcgctgagctgaatgaaatgatttataaaggaatttcaatcaaatcggccgtcgtgcgtgaggacgaaaaggaagagggcataagagcttttctgaatttcggccatacgctcggccatgccgttgaggcggaatacggctacggccggattactcatggagatgcggtcgccctcggcatgcagtttgccctttacgtgagtgaacaggttgcgggttgcaagatgaacaggaaagaactcacacaatggctgattgggctcggctacccgggaagtatcagacaagatattgaaacgccggttctctccgcccggatgatgaatgataaaaaaacgcgcggaggcatgacacagttcatcgtgttaaaggaattaggggaagcgcgggactgcatgctttcaaaagatgagctcgaaaatttgctgaacaaatggcgaatggaggaaacagcatgatgatacgcggcattcgcggagcaacaacggtggaacaagacaccgaacaagaaattttagaaaaaacacagcagctgcttgaaaaaatcattgaacaaaatggatgcaagccggaagacgttgtacagatcctgttatccgccacgcctgatatccattccgtatttccggcaaaagcggtccgccgcctttccgggtggcagtacgtcccggtgacgtgcatgcaggaaatggatgtcaccggcgctctgcaaaagtgtatccgtgtcctgatgacggttcagacggatacgcctcaggatgaaatcaagcatgtctatttagaaaaagccgttgtgttaaggccggatttatcattgacaaaaaatactgacatgtaatacgataaacaaagcttagaaatacacaagagtgtgtatagagctggtaagtaagatattgaacagttgagtttagaatagggtagcagagaatgagtttagctgagctgagataaacacgtttttattctgcccaaaagaagcctttcttttgggtttatttcttatacgcaagactcctctcactcttcatctcattctccttaccgtaaggaggagaatcatgaatttacaatcggatgtttctttatttttaaaggacagtctgacacaccgcaccattccaatcgcagagacttttacggtcgacacgatcacacccattcagatggttgaaaaactggacagaaacattacgtatcttttagaaagcaaggatgagtcgtcaagctggtcgagatactcttttatcggcctcgatccttttatcacgattaaagagagtcatcacacattcactgccgctgatccaaacgggcatacgctgtttgaagccggagaattaaaagccgtgcttgattggatgaatgaaagcttccgcattaaaacacccgagcttgatatcccgttttcgggaggggccgtcggttatctgagctatgacatgatccctttgattgagcctaccgtgccgagccacgcgaaagaaacagatttcgaaaaatgcatgctgtttgtctgccggaaaatcatcgcgtacgaccacgaaacgaaacaagtgcatttcattcaatatgcggcgcttaacggccgggagacggaggaagaaaagcgggccgtttttaaagaaaattgcgcggagcttcgtaagcttatcggtattttgacagaaccgaaagatatgaaagagccgtttttttctaaagaaacatttgaaacgccaagttttgccgatatgacatctaattatacgaaagaagagtttatggccggcgtcaataaactgaaagaatatataaaagccggagacatttttcaaggggtgctttcgcaaaagtttgacattccggtatccagacattcatttgagctgtacagggtgctccgcatcgtcaatccttcaccttatatgtactatatcaaactgcctgacagagacattgtcggaagttcgcctgaacgtctgatccgcgtggatgacagacacctggaaattcatccgattgccggaacgagaagaaggggcgccggaaaagaagaggacgatcgcctcaaaaaagagctgatgaatgacgaaaaagagaaagctgaacattatatgctcgtcgatcttgcgcgcaatgacatcggcagagttgcggagtacggttccgtagccgttccggaattcacaaaggtcgtttctttttcacatgtgatgcacatcatctctgttgtaaccggccgtttaaaacagggcgtccatccggttgatgcgctgatgtcggcattcccggcaggaacactctcgggcgctccgaaaatccgcgcgatgcagcttttaaatgaattagaaccgacttccagagaaacctacggcggatgtatcgcttatatcggatttgacgggtcaattgattcgtgtatcaccatccgcaccatgagtgtcaaaaacggtacggcgtcggtgcaggcgggcgcgggaatagtcgctgattccgtcccggaagccgaatatgaagagagctgtaacaaagcgggggcgcttttaaaaacgattcaaatcgcagaagacatcttttctggcagggaggagaagacggatgaacaaatttctgcaatcgtgcgttaatggccgcacgctgaaaaccggagaagccgaaaagctgatggagatgatgatgaacggggccatgtcgcagtctgagatcggggggattttatcggtattagcccaccggggtgaaacggcggaggagcttgccggatttgtaaaagtgatgcgggcgcgggcacagacggcgggtggcttggcggatgtcgttgatacgtgcggaacaggcggagacgggatttctacgtttaacatatccacggcagcggcgattacagcttctgccgccggagctaaagttgccaagcacggaaatcgctccgtttcgtctaaaagcggcagcgcggatgtgctggaaaagctgggggtttccattcaagccactccagaaagcgtcaaacgcagcattgaaatgaaacaaatggggtttttgtttgcgccgctgtttcattcgtcaatgaagcacgtcgccgccgcaagaaaagagcttggcttccgaaccgtatttaatctgctgggcccgctcagcaacccgctgcaggtgaagcggcaggtgatcggcgtctattcatttgataaagcgcgcctgatggcaagcgctttggaacaatttgatgtcagacacgtcatgcttgtgtcggcgcgtgacggattagatgaactgtccatcacagcaccgacagatatcattgagctgaaaaacggtgaacgtctggaatattccgtttcacctgaacaattcggttttgcagaaggttcattgaaggatattcaagtgagttcatcggaagaaagcgcgcttctcattcagaatatttttgcaaatagagctccgtcatccgctctgcatattaccgccttaaatgcgggcgcggccatttatacggcaggtcttgcaaacgatctgaaagaaggaacgaaaacagccttagaagccattcaaaacggagatgccaaaaggcagctcgaacgtctgaaacagaaagaggaagaaatgtatgcttgatcaaatcattctgcagaaaaaagaagaaatcaaatccatcgtgctgccggaaacctgtcaaattgaacggagatcctttaaagaagcgctcctgaacccgaaccgttttatcgggctgattgccgaagtgaaaaaagcttcgccgtctaaaggattgattaaagagcattttgttccggaaacgattgcggcggattatgaagcggctaaagccgacgccctttcggttctcacggatacccgtttttttcaggggagaaatcaatttctgacagatgttaaacaaaccgtgtctcttcccgtgctgagaaaagattttattattgattcccttcaggtggaggaatcgttcaggatcggcgccgatgccattttgctgatcggggaagcgctggaacctccaaagcttcatgagctttatctggaagcccgcgggaagggcatggacgttctcgttgaagtccatgatgaaactgtgcttgaacggattttacaagtgtttcagccggacattctcggcataaacaaccgggacttaaaaacgttccgtacttctgtttcgcaaacggaaaaaatagcgcagcttgtgccggacggctgcctgctggtcagcgaaagcggcatcggttctttggctgacctgcaattcgtcaacaagcacggggcgcaggctgtattggtcggagaatccttaatgagagaggattcgcagcaaaaggcgatccgcggactgttcggagagtgacgatatgaaaaagcctgagttaaagtactgcggaatacgatcgaagcgtgattatgaacttgcggcagcttcagaagcggattatctgggatttatttttgccgcaagcaaacggagagtaacgccggatgaggtccggaaatggaaagagcaggtccggacagacaagaaacatgtcggagtatttgtaaatgaaacgatagaaaacatcgcgcaaatcgcatctgatctggcacttgacgtcatccagcttcacggtgatgaatcgcctgaggatgcccttcgcctccgtccgcttgtgcgctcggaaatatggaaagcgctccatcacggggaagggacgctccgtcagatggctcaatttacacctgctgtcgacggctatgtcattgattcttcagtgacaggaatgagaggcgggacgggaatcgcgttttcatgggcccgtgtccccttgtaccgaaagcaggctcaaaatgcaagcaagcgctgttttattgcgggcggtgttaatcctgaaacgattaccggcttactgagaacgcgtccgtgcggtatagatcttgccagcggaattgaaaaaaacggacacaaggatcaaacactgatccggcttttagaagaaaggatgaaccactatgtatccatatccaaatgaaatcggaagatacggcgaattcggcggcaaatttgtccctgaaacattgatgcggccccttgaggaaatcgaaacggctttcacagaattaaaaaatgatcctgtttttcatgccgaatataaaaaactattgtttgattactccggaagaccgactgcattaacgttcgcagacagggtgtcagagtatttgggaggggcgaaaatctatctgaaaagagaagatttaaaccataccggctctcataaaattaacaacgcgttaggccagattctgcttgctaaaaagatgggcaaaacgaaaatcatcgccgaaaccggtgcgggacagcacggtgtggctgccgcgacagccgccgcaaaattcggttttaaatgtacggtttttatgggtgaagaagacgttgcgcgccagtcgctgaacgtattccggatgaaactgctcggcgcggaagtggtgccggtcacaagcggcaacggcacgctgaaagatgcgacgaatgaggcaatcaggtattgggtccagcattgtgaagatcatttctatcttatcggttctgtagtgggtccgcacccatatccgtatatcgttcgcgaatttcagaaaatcatcggcgaggaagcgaaagaacagctccgccgggttgaaggaacgctcccggacaaggttgttgcatgtgtcggcggcggaagcaatgcgatgggcatatttcaggcctttttagacgaagacattgagctgatcggcgccgaggcggccggaaaagggattgatacgccgctgcatgcggcaacgatcgcaaaagggacgctcggggtgattcacggatcaatgacctatttaatacaagatgaatacgggcagattatcgaaccgtattccatttcagcaggccttgattacccggggatcggccctgagcacgcctatctgcacaaaagcggccgtgtaacgtacgaaagcgtgacagacgatgaagcgattgccgcgttacgtctgctttctgaaacagaaggtattcttccggctattgaatctgcccacgccctggcaaaagcgtttgaaatggcaaaggacatggataaagacaaaatcattctcgtcagtttgtcgggaagaggagataaagatgttcatacgctgatgaatgttttggaaaacggggtggagacacatgtttaatctgcgagattctgaaaaattgtttatcccttttatcacagcgggcgatccgcttcctgacatttctgttgaactggcaatatcattacagaatgcaggcgcttctgcccttgaaatcggcgttccttacacagatccgcttgcggacggacccgtcatacaacgggcttcaaaacgggctctggaaaacggaatgaatatcgtaaaagccattgaacttggcggcaaaatgaaaaaaaacggcgttcatattccaattatcctctttacgtattataatcctgtgttacaattagaaaaagaatactttttcgctttactgcgggaaaacgacatagacggcctgcttgtacccgaccttccattagaggaaagcgcccttttgcaaatgacatgcaaaaaggagaacatcgcttatatctcgctggttgcgccgacaagtgaagaccgtttgaaaataattactgaacaggcctgcggctttgtgtattgtgtatcctctttaggagtgacgggcgtacgcagcgaattcgatccgtctgtatactctttcatccgtaaggtgaaagaattcagctctgttccggtggcggtcggttttggcatttcaaaccgcaaacaggttgacgggatgaatgaaatatctgacggtgtcgttgtcggcagcgcgcttgtcaaaaaagttgaagagcttaaaacaaagcttgtgaatcccggcacaagagctgatgcgcttcttgaatttgaagaatacgcgaagacgttcggacgactgtacagtgtaaaatgaggtgactggatttgcagattaaagaacagctgcggcagctgaaaccgtatcagccgggcaaaccaatagaagaagtgaaaatggaatacgggcttgaaaaagtagtaaaactcgcttctaacgaaaatccgttcggctgttcacaggccgcaaaagatgcgctgcatcaggagattgagcagcttgcgctgtatcccgacggttacagtgccgctttgagaacgcggctcagtgagcatctgcaggtcagtgaatcttcgatcattttcggcaacggctctgatgagctagtgcagattatctgccgttctttattaaatgatcaggcaaacacgattaccgccgccccgactttcccgcaatacagacacaatgcggtgattgaaggcgctgaggtgcgcgaggtgccgctccgcagtgacggcgctcatgatttagaccggatgctggaagcaattgacggcgagacgaaagtcatatgggtatgcaaccccaataatccgacggggacatatacttctgagcaagagttaattgcctttttaaacagagttcccgagcatatactcgttgtacttgatgaagcgtactacgagtatgttacggcggacgattaccctgaaagcatcccgcttttaaagcaatatccgaatgtcatgatcctccgcaccttctctaaagcgtacggacttgccgcgctgcgtgtcggatacggcattgcggacgaagcgctgatccgccagattgaaccggcgagagagccgttcaatacgagcagaatcggtcaggcttcggcactggcagcgcttgacgaccacacatttattcaggaatgcgtcgagaaaaataaagcgggccttaagcagtattatgattttgcggaaactcacggattaacttgttatccttcacaaaccaactttgtgctcattgattttaaccgtccggcggatgaactgttccaagccctgttggaaaaaggatatatcgtccgttcaggacaggcgctcggatttccgacagcgttaaggattacggtcggtacgaaagagcagaatgaggaaattctcacaatcttagctgaaatattataagaggtgatcaagcatcacctctttgctctattaaaatagttgaaaaaggaaatgagtgaaatgaaggatactatattgcttgcggggatcgggctgatcggcggatcgatcgcattggccatcaaaaaggagcatccgcataaacggattatcggtgtggatatttcggaagaacagctcactgccgcgctgaagctcggaattattgacgagcgggccggctcattgacggaaggggcgcagcaagcgtctgttgtcattatcgccacgcctgtcgcccaaacgctgaaaatgctcgatatgctggccgcatcagacatcacccatgaactcctgattacggatgtgggcagcacgaaacagaaagtcgtcagctacgccgacaaagtgcttccggctcattatcaatttgtcggcggccatccgatggcggggtctcataaatccggggccgctgccgccaaagaatttttattcgaaaatgcgttttacattttaacacccggaaaatcaacttctaaagagtcagtaacgcatctgaaggagcttttgaaagcggcaaacgcccactttgtggagatgactcccgaggagcatgacggcgtaacgagcgtcatcagccatttccctcatatcgttgctgcaagcctcgtccatcaggctcatcattctgaagaaaattatccgtttttgaagcgtttcgcagccggcggttttcgggacatcaccagaatcgcctcaagcagtccggcgatgtggagagacatacttcttcataacaaagataaactgcttgaccgcttcaaagaatggaaacgggagattgacacgatcgaatcttatgtagaaaatgaagatgcggacagcctgttcggatattttaaaaaagcgaaagattatcgcgacggcctgccgctccgtcaaaaaggagcgatcccgtccttttatgacctttatgtcgatgttcccgatcatccgggggtcatttcggaaattacggcgatactggcagaagaaaaaatcagtatcaccaacatccgcattatcgaaacaagagaagatattaacggaattctcagaatcagtttccagactgatgatgaccggaagcgcgcggaaacctgcattcaatcccgcgccaaatatgacacattttacgctgactgaggtggaaaacattgaaaagagaaaaagtgacgtctttaaacggtgaaattcatattccgggggataaatccatctcccaccgttctgttatgttcggagcgcttgcggaaggaacgacaacggtaaaaaactttttgcccggagccgattgtctgagcaccattgcctgcttcagaaaaatgggtgtctccattgaacaaaacggaagtgatgtaacgatatacggaaagggcattgacgcactttgtgagcctgacagccttcttgatgtcggaaattccggcacgaccatccgcctgatgctcggcattttagccggacgcccatttcacagtacggtagcgggtgacgaaagtattgcaaagcgcccgatgaagagggtgacggagcctttaaaacagatgggagccgcgattgacggaagagcggacggagggtttacgcctttatccgtaagaggcggacaattgaaaggcatagattacgtctcccctgttgcaagcgcgcagatcaaatctgccgtgctgcttgccggattgcaggctgaagggacgacgaccgtcactgagcctcataaatcaagagaccatacggaacggatgctgaacgcttttggcgccgagcttgcggaaacggagacgagcgcttccgtaacgggcggtcagaagcttcggggagccgatattttcgtgcccggcgatatttcttcagcggcctttttcctcgcggcaggcgctgtcgttcccggaagccggattgtgctgaaaaacgtcggcctgaacccgacacgcacgggaatgattgatgtcttaaagcaaatgggggcttcacttgaagtgattccttcagaagcggacagtgcggagccttacggagacctggttattgaaacctcagctctgaaagcggcagaaatcggcggagaaatcattccccgtttaattgacgagatcccgattatcgcccttttggcaacgcaggctgaaggcacaactgtcattaaagacgctgcggagctgaaggtgaaggaaacgaaccggatcgacaccgtcgtatcagagctccggaaaatcggcgcagacattgaaccgactgaagacggcatgaaaatacacggcaaaaaaacgcttgcgggcggagccgatgtgtcaagccacggcgaccaccgcatcggcatgatgctcggtatcgcttcatgcctgacagaagagccgatcgacatccgtgatacagaggcgatccatgtctcatatccgacattctttgagcatttagatcaattagccaaaaaagcctgaagacgattcttcgggcttttttcttcatgtgtcataaaatcttgggctttgacatagcttgtcttaaacagaaaactaaaagaaagggggaatgcgttttcgttacagaaacagccggaacaaattgcgctgtttgcgtataaagatgccgtccccttttttgccgttttcctcttaaccattttctgataaactataatgccgggtgaagcatcttatttgcgggcaggccctgtctgaattatgataagaataacccgaataaaaacccttttcatttggttgatgaggtataggaaaagaaaggaccggtctgatttgaatacattgattcaagaagccataaaattagttgaagcaggtgaaaccgaaaagggactcaaagcgctttcaaaagctgaaacagagcttcatgacgaagacaaagccattgcagcccagctctactatgaatggggaaacgccgaaaaagcgttagcgctgatcagtgatctgcatgacctctatccgggtgagtctgagctgacgaatttttacgccgaattgttaatagatattgatgaagaagaaaaagctcttgaggtgctggagacgatttctccggaagacccgtcttacgcggaaagcctccttttaatggctgatctgtatcagatgcagggcttatttgaagtaagtgagcaaaagctgttacaggcgaaagcgatgttacaagatgaacctgttattgatttcgctctgggggaattatacttcactcagggatcatatgcaaaagccgttccttactatgaagagacggcaaaagaacggcacgaaatcggcggcgtaaacgttcatcagaggctggctgagtcattgagcgcggcgggtgaatttgaggaagcgatttcatggtatgaaaaagcggcggcagaacatacagaaccgaatacgattttcgggtacgggttcacagcctatcaggcgggaatggtcaaaacagccatcaagcagctgtctgatttaaaagggcttgatccttcctattcatcgctttatatgccgcttgcaaaaagctacgaggcagaaggcatgtatgaagatgcattaaaaaccgctaaagaaggtattacttacgatgaatacaataaagagctttttctctatgcggcgaaaatggcgttaaagctcggcagcgaagaggaaggcaaaaagcttcttcaggaagcgctggcgctcgatccgggttacgtggaagcgctccatacgcttttagccgtctatcataaagaagaaagctttgaagagattattgatctgattcaggaagtccgcggctacggagaagaagatccgaaatacaattggtatttggcgggggcctatacaggcctggagcaatacgctgaagcgaaaaaaagcttcgaagctgcgtatctccattatcaggatgatcgggatttcttatatgaatacgctcacttcttattggaagagggtctccagaaagaagcgctgccgcttttaaaacaagtgctttcaatggatggaacaaacgaagagcttgaagaaacaatcttacggatagaggatgaatttttaagataagcaggattttggaccatgcttgctgaatgtataagtgatgtcagattatacgatcgatagaggagggaattacatgcagacccctgtttctgtcaatgaaaaaaaggattttatccgttggtttttaaatcattatcagcttaaacgccgggagtgcgtctggattttaaattatttaatgagtcatgattcattaatggaaaaagtccattttgtagaacaagccgaattttgcccgagaggcattatcatgtctactcattgcgttgatgaggtgccgtttaggttttacaaagaaaatgtcatgactacggacgcggaaaaatcttttcacgacatccggttaaataaacagcaggatttatttatccagctgaatttccgttcggcctacagctcaccggaatatgccgctgttcttgaatcaaatccgcatctgccgaaagacctgtttgaaaataaacaggatcaggggatggctgaaaaaatattagaacatgccatttccactttccagcgggaaaagctgcttaaagatatcgacgaggcgctggaccgccacgacaaagaaacatttgaaaagctttcccgccaattgaatcagctcacataaatgacagccttgcagaatatgcaaggcttgttgcgtaaagaggaggaacgagacatgagatggagggccgctgatgccgatgcctatttacaatctgcggattacattgataccgctgtcattccgttaatttccataacgtcttcaggaggcttaaaagaggccgttgaacagggggaaagcacccaattgctttctgaagagcttgagcgccaattgaagggacgggtatatttattcccctcttatacatatgttgatatagaccaatcacaaatcgccctgcttcaaaaactcaaagaagaggtgatgaccaacttcaggcacgccttgttcctgacggcagacgaaaaatggaaggattctgaaatagggtctgatgtcatatacatacctgccgttccgtttgaacatatgaaagactctttaaagagaaaaattgcggatgacaagtgcggagaaattttgaacgttttgttacagaagtggaacaattcttaaaaactccaggcatcctgcaaaacacccgttttgcctctgttgaccttgctgaaagattcatatattatgagggtgtcaaatctcagaattattttctattttagttaatttttggtcaatctttagggggggaagagatgggcggaaaacaagatatatcaagaagacaatttttaaactatgcgctcaccggcgtggggggatttatggccgccagtgcgcttatgcctatggtccgttttgcgctggatccggtattaaaaccgacgggagatcaaaaaatggtgcaggttgtcagtgtggatgagctgacgaaggagccgaagcggtttgactttaaaattcatcaagtcgacgcctggtacgaatcggaagaatccaggtcagcctgggtttacaagcatggggatgaaattatagcgctttctccgatctgcaagcatttgggctgcaccgtaaactggaacaatgatcctaaaaatccgaacaaattcttttgtccctgccattacgggctgtatgaaaaagacggcacgaacgttccgggcacgccgccgctcgcgcctcttgaccgttatgagcaaaaagtaaaggacggctttttgtatcttggaaaagcaaagcctaggggggaagggtgacatgctgaataaaatttatgactgggtggatgaacgtctcgatattacgccgatgtggcgggatatcgccgaccatgaagtgccggaacatgtaaatcccgctcaccatttctcggcttttgtctattgtttcggcggtttgacgttttttgtaaccgttatccaagtgctctccgggatgtttttaacgatgtattatgtgccggatataaaaaacgcgtgggaatctgtgtattatttgcagaatgaagtcgctttcgggcagattgtaaggggtatgcaccattggggcgcaagtttagtcatcgtgatgatgtttttacatacgctgcgggttttctttcagggagcttataaaaagcctcgggaattgaactggatcgtcggtgttctgatcttttttgtgatgctcggtctcggatttacagggtatttgcttccgtgggatatgaaggcgctgtttgcgacaaaggtaggtcttcagattgccgaggcgacgccattgatcggagcgcaggtgaaaactcttcttgccggccaccacgatattgtcggcgctcaaacgctgacgagattttttgcgattcacgtattttttctccctgccgctttgtttgcgctcatgggcgcccactttgttatgatccgcaagcagggaatttcaggaccgctttaatacaaatctgatataaaagggaggggatgacatgcaccgggggaaaggaatgaagtttgtaggagattcaaggataccggctgaaaaaaaaccgaatataccgaaagactattcagagtatcctggaaagacagaggcgttttggccgaactttctgctgaaagaatggatggtcggggccgttttcctcgtcgggtttctcgttttaacgattgtgcacgagccgcctttggaacgggtggcggatcctacggatacagggtatattccgctgccggattggtattttctatttttataccagcttttaaaatatgaatatgccgcagggagctacaccgttatcggagcgatgattataccggggcttgccttcgggtcgctgcttttggctccgtttctcgacagggggtctgaaagaaggccgtggaagcgtccggttgctgtcgggatgatgcttttggcgctttgcgctacggtctttttaacgtggcagtcagtcgcgacacatgactgggcaaaggcggaggagcaagggaaaattaaaaaagaagccgccattgatactgaatcagacggttataaggtatttaaagaacaaggctgtatttcctgtcacggggataatcttcaagggggaggcgccggtccgtccctggtcgataacgggctgagcccggaagaaattaaaaaaatcgccgtcaaagggaaagggcagatgccagccggtatttttaaagggaatgacaaacagcttgatcagctggcgaagttcatttctgaaacgacagcgaaataacgtattgtgaagtagacaacagcaggatatactttatgaaaagagctgaccggatgtcagctttttttgcatgatacatactttttacggactgagagttgatggtatgaggtggatttcttatcttttagggttgcgcggcatgcttctgcttgttcttgccgttaattttatcggtacggtgtacggctattattggtatgtgccgcagcttgcggacacgccgttccgatttctgatatttgtgcctgacagcccgacggcgacgtttttcttcctgtttgtgcttctggcatttctcatgggaagaaacgcgccgctgtttgaagcgctggctcttgtaacccttgtaaaatacgggctgtgggcggtcggaatgaatgtctttgtgctggtcaaaatggggcagatgccttgggaagggtatatgctgattgcttcacattttgccatggccgttcaaggcgttttatacagcccgtattttcggttccggttatggcatcttgccgttgctgctgtttggacgcttcataatgacgtcattgattatcttttcggcatgatgccccgctactcaatgctcaatgactatatgcaagagatcggctatgctacattctggctgagcatattttcactcggccttgcatactatttggtgatttctaaaagacggataaagcttgacttacactgatagaatcttggtctaaccttgtcccgctcctcatattctgtaaagagaaggagtgggagggacctctatgaaacgaaagctgacgatctgtcttttacttgctcttatgtgtttcatcacaactgccaaagctgaagatgagggcggtctcaaggaactgaacgacctttcggataccgttttccaaatgacgcggcattcgcagtatgatgaggctctgcaagtgcttggctactttaagaaaaaaatgacacacgtaaactcactgagcggcgccgaagtcaggcaggtgactctgggcttcaatgatttagtgcgcgtcctgaaacaggcagacgcctcagataccgaaaaaatccgggcagccgcccagttcaggttggtaatggatgcgatggaagaccactccgatccgctgtggggttcgcttgaaagaccgattatggcgacattcagcgccttaaaagaagatgtcagcggaaacggaagtggaaatttcaatgaaaagtggaatgaatttatatcattatatgatttaatttatcccagcctgacaatggatgtgtcggccggccagcttgatacggtggcgaaacatatcgaggtgattgagcaggaagggtttcagcagatgacaaaaggaacaaagcttgagcgtctgacactcctgcagcaggatttaaagcgggtttttgacaaggtggagcgggatgacgctgacccttcgctgctctgggtcattctgacaacaggcggtatcattattactgcgctgacatatgtcggctaccgaaaatacagagcggaaaaaaagaaagagaaaaagcgtgagtatcctaagtctaaataaacacaaattgctgtaaaggagctaagtcagtgaaaaaactcatccagcaattggcttcaaaacacctcccgcagccgatcagaggcagaaaaggggcgactgacgaaggaccgcgaaacctcgcgcgtgacttccagaatcctgacatgctcgttccgccttcaacggatgcaggaacggttcaaaacttgaaattctcattttctgatacgcatatgaggcttgaagacggcggatggtccagagaggtgacggtcagggaactgccggtatccaaaaacatcgcggcggtgaacatgaggctgaaaccgggagctgtgcgggagcttcattggcataaagaagccgaatggggatatgtgattaacggaggagtacgtttaactgcggtcgatcaaaatgggcggaattttattgataacgtaagtgaaggggacctgtggtattttccttccggcattcctcattccattcaaggattagagcagggaagtgagtttttgctcgtctttgatgacggctctttttcagaaaacagcaccttttcagtaacggactggtttgcccacaccccgcgcagcgtgctggaggcgaacttcggtgttccgggctatgagctggcttacattcacaagaaagagcgttatatgttccagttggaaccgccgcccccaattgagcgggcagcagtctcttccccggaaggccccgttttagagccgttcagctacaagctttcccggcaggagcctcttgttaccagcgggggaagagtaaagattgtcgattcaaaaacgtttaaggtgtcaaaaacgattgctgcagctcttgtggaggtcgaacccggaggcatgagagaattgcattggcacccgaatacggacgagtggcagtattacctttcaggagaagcgaaaatgacggtgtttgcggcggagggaagagcgcggacatttaactatcaagcgggtgacgtaggatatgttcctgttgcaatgggacattatgttcagaataccggtgacaccgtgcttcgctttctggaaatcttcaaaagcgaccgtttcgaagacgtctccttaaaccaatggctggcactgacgccgcagcgcttcgtcgagcagacgctcaatgtcagtccggcattcgcccgccgattgaaaaagaaaaaatcaccggttgtcaaatggaaacacgaacagtaaaggcggcaaaagccgcctttttattatcgtctgatcggatttttattttcatcaagcgtaaatccttcgccgagcacatcatggacgtcgcttactgcaacaaaggcgtgcgggtcaacggaagtgatgacgcttttcaaaagcacaatttcgtttttcggaacgacgcagtaaagaacgtccctgtcttcttttgtatatgatccctgtccttttaaaacggtgacgccgcgctccatctcttcaatgattttttgctggatcaaatcgtttttcgaagaaataatcgttgccccttttgcggcatagccgccttcctgtataaaatcaatcaatctcgcagcgacaaaaacggctacaagcgtgtacatcgcttccttgtaagaaagatacgtaaacaaagaaagcagaatgacacaggcgtcaaaggcaaacatcgtccggcccatcgggattccgaaaaatttgttgatcagccgagcgatgatatcgaccccgcccgtcgtgccgccgtatttaaaaataatgccgagacccgcgccgataaaaacaccggcgaacaaggcggccagcgctaaatcatgcgacagcggcatatgaatttcgtagcgctgaaaaacactcagaaaaacggaaagagagacggtgccgatcagggtatagacaaacatcgtccggccgagcatacgccagccgatgaaaaagataggaatgtttaataccaggttggaaatagaagggctgatgtggaataacgcatataaaagcagcgtaatgccggtaaatccgccttccgccaaattgttctgcatattaaagtgaaccagtccgaatgaaaaaacagcggcgccgattaaaataaagcaaatgtttttgattctgatttctccaagcattgcatcaaaccccttttccttccataagattgcgtaaatattatagtggatacaaaagaaaacagcaaactgccgtttttaacatttgtcaaatgtacttgaattagctaacatggaagagatgacaggaggtattcgcacagtgagtgacaaaacgatgaaagacttacaagctgaggtcgatgaatatatcggccaattcaaagaaggctatttcagcccgcttgccatgatggcccgtctcacggaagaactgggcgaacttgcaagggaagtcaaccattattatggggaaaagccgaagaaaacgacggaaaatgagaaaagcatggaagaggaaatgggcgatgtgctgttcgttctgatctgcctcgccaactcccttgatatttcattggaggaagctcataaccgcgtcatgcataaatttaatacacgtgataaagaccgctggactagaaaagaagaaggaaagtaggagaaaccatgtcaaatgaaaccattaaagtcgtcattgccggaccgagaggcagaatgggccaggaggccgtaaaacttgccgtccgcacgcctcattttgagcttgtcggcgccattgaccatacatacgatcagcaaacattacgggaagtgatgtcagctgattcagacgctcttatttatacggatatccgcgcatgtttccaagaaacaaaaccggatgtgctgatcgatttgacaacgcctgaaatcggcaaaaaacatacgaaagccgctcttgaacacggcgtccgccccgttgtgggaacgaccggattttctgaagcggatttagaggagcttcaagccttgactgaagaaaaaggaatcggcgccatcatcgctccgaattttgcattgggcgcggtgctgatgatgaagttctcacaaatggccgccaactattttgaagatgtagaaatcattgagcttcatcatgatcaaaagctggatgccccgagcggaacggcgctgaaaacagcggaaatgatttcaagcgtccgtacagaaaagcagcagggccatcctgatgaaaaagaaattctgccgggcgcccgcggtgctgaattaaacggcatccgccttcacagcgtgcgtctgccgggccttatcgcccaccaggaagtcatgttcggcatggacggccagacgctgaaactgcgccatgattcctataaccgggcttcctttatgtcaggagtgaagctgtcagtggagcaagtgatgaaaatcgaccagcttgtatacggactcgaaaatattatcgactgaatcggcaagggggagaacatcaaatgaaaattgctttgattgctcacgataaaaaaaagcaggatatggtccagtttacgaccgcatataaagatatattgagccatcatgagttatacgcgacgggtacgacaggcttaaaaatccaggaagcgaccggattgtccgttgaatgttttcaatccggcccgctcggcggagatcagcaaatcggcgcattgattgcggcaaacgccctggatctcgtcatttttctgcgcgatccgttaactgcgcagcctcacgaaccggatgtctccgcgctgatccggctgtgtgacgtatacgcgatcccgctcgccacaaatatgggaacagcggaaatccttgtccggacgctggacggcggggcatttgatttccgcaatcttgtgcgcggaggagagccgaatgtctgaacacgttgatattctggcgttcggcgcccatagtgatgatgtcgagatcggtatgggcggcacgatcgcaaaatttacggctcaaggaaaaaccgcggtgatatgcgatttgaccgaggccgaactatcatctaacggaacggtagggataagaaaagaagaagcggcagaggcggcacgaattctcggcgtaaaagagagaatccagcttacgcttcccgaccgcgggcttttgaaaagtgaggacggcatccgccggattgtcagtgtcatcagagcctgccggccgaaaaccgttttcatgccttatccgaaagaccgccatcctgaccacggcaatgcggcggctttggtcgaagaagcggtgttctcggcgggaattcataaatacagagatcatcaggaactgccggctcataaggctcagcgcgtatactattatatgatcaacgggtttcaccgtccggactttgtaatcgacataacggaaaccatcgatctgaaaaaagaaagcctgcacgcttatcaaagccagtttattcctacggcgcagtcagtgaacacaccgctgaccaacggttatatcgaaatggtggaagcgcgggaaagactgtatggcaaagaagccgggacggggtatgctgaaggcttcttttcaaaacagcttcccgttttgaatgatgatgtttttgggggcggacaatgagaccattaaaaatagggattacatgctacccgagtgtcggaggctcgggtattattgcgacggaactcggcaagctgcttgcggaaaaagggcaccaggttcatttcatcacatcaagcatcccgttcagattaaatacatatcatccgaatattcattttcatgaggtggaagtcaatcaatacgcggtatttaaacatccgccttatgaccttacactggcgagcaaaatcgccgaggtggccgcgagggaaaatcttgatatcattcacgcgcattatgcgctgccgcatgcggtatgcgcttatctagccaaacagatgctcaagcgtgacatcgggatcgtgacgacgcttcacggtacagacatcaccgttttaggatatgatccgtcattaaaagatttaatccgttttgccatcgaagcgtccgacagagtgacggcggtatcaaccgcgcttgccggagaaacatatgacttaatcaagccggataaaaaaattgagaccatctacaactttattgatgaacgtgtttatcttaagaaaaatacagagagtataaaagagaaacatggtattttgccggatgaaaaggtcgtcatccatgtttcgaacttcagaaaagtaaaacgtgttaaagatgtcatccgcgttttccgtaatatcgcagccaacacaaaggcgaagctcctgcttgtcggtgacgggccggaaaagtgcgtcgcttggcagcttgtcgaaaaatacggactgcaggatcaagtgctgctcctcggaaatcaggacagggtggaagagctgtattccatcagcgatcttaagcttcttctgtctgaaaaagaaagtttcggactcgtcctccttgaggcgatggcctgcggcgtgccgtgcatcggaacaaatatcggcggcatcccggaagtgattaaagatcaagtaagcggttttctggtggaagtcggcgatattcaggcggcatctgaaaaagcgcttgccgttttagaagataaacagctcagcaaacgattgactgatcatgcgctgaaaatggtggagacctccttttcttcgcaaagaatcgtcagtcagtatgaacggatttatgacgaattggcaggaccggagtgatcttatggaacaggaatttgtcaaagccctccccatccttcatcatctgatgaaggcgggccatcaggcgtactttgtcgggggagccgtcagagacagctatatgaaacgaaaaataggtgatgtggacatcgcaaccagcgcttcgccgaatgaggtggagcgcctctttaagcggactgtcgatgtaggaaaagagcacggcaccgtcatcgtcctgtgggaagatgaaacctatgaagtcaccacttttcgtgccgaatcagaatataaggactatcggcgcccggaagctgtgcggttcattacttctttatcagaagacttaaagcggagagacttaacgattaatgcgatggcgatgtctgccgaaggagagctgcttgattatttcggaggcgcacatgatatcggacaaaagctgatccgtacggtgggtaaccctgaagaccgttttcgggaagacgctctgcggatgatgagagccgtccgctttatgagtcagctcggctttctgttagaaaaagaaacaagagaggccgtcataaaagacagggagcttttggcacatgtatcagtagaacgaaagaccgtcgagtttgaaaagctgatgcagggcgctttctcacaagaagcgattcaaacgatggtgcagacaggtctgatacaagagctgcccggcctttccggttatgagcagcaaatgcttgaagcaagcggctttccgttttcttctttagatgcacgcgaagaacgctgggcagcgctgttattgtttctcggtctttgtccgaaaagtgccgaggcgtttttaaaacaatggaaactgccgggaaaggtcataaaaaaagcggtgcagatcataagcgtttatccggcgcagctggaagcagaagcgatgtaccgagcgggagaggcgctgttttcagccgttaaaatcgggatgctgaaacagcataagacgattgatgaacaaaagctgaaagaggttcagagcctgtatgagcagctgccgatcaaaagccttcgagacctcgacatttcaggcgctgatctgatggagctcagaaaccgccgcgcgggtaaatgggtggccgaagaacttcgccggattgaagaagcggtattggcagggaagcttcctaaccgaaaacatgacataaaggagtggctcgcatcatgggatcaacattaagaacccgattaattgatttattttctgaggcgggtgacggctttatctccgggcagaaaataagtgacgcgctcggctgctcgagaaccgccgtttggaaacatatagaggagctccgcaaagagggctatgaggttgaggcggtcagacgaaaagggtacaggctcattaaaaaaccggggaaactcagtgaatccgaaatccgtttcgggctgaaaacagaggttttgggcaaacagcttcattaccgggacgtcctgccgtccacccaaaaaaccgctcatgaacttgccaatgacggcgcgccggaagggaccctcgtagtcgccgataaacaaacggcaggcagaggaagaatggccagagtatggcattcacaggagggaaacgggatttggatgagcctcattctgagacccgacgttcctttgcaaaaaacgccgcagctcaccctgttatccgccgttgcggtcgtacaggccatcgaggcttttacaggcgtacaggccgccattaaatggccgaatgatttaatgattcacggcaaaaaagccgtcgggattttaactgagctgcaggcggaagaggaccgtgtccgttcggttattctcgggatcggcatcaacgtgaaccagcaggaaaccgattttcccggcgagcttcaggacattgcgacgagcctgagcatggaagccggtgaaaaaattgacagagcgggtctgatacaagagattctgctgacttttgaaaaacgctatcaggattacttgaaccacggctttacaccgatcaagctgctatgggaaagctatgcggtcggactggggaacgagctcagagcgagaacgctgcaaggaacgttttacgggaaatcgctcggcattgatgatgagggagttcttcttttggaaacgagagacggtataaagaagatctattctgccgatattgagctcaattaatcttagttggtacaagcctcgtgaatttggtatacttcctatgggcagtatcataatgaactgcacctgatcagcagaacagagattacgaaaagtctgccttgatccaaaaaaggactgggacagagggatgacattcgccgaacgttaaacaagtgggaatccttcttattttacagaaggcttttttgcttgcgaagaattggcggctcatctcctcaccgtttagaggaggagaaacagaatgaaaacaaaactggatttcatgaaaatgaaggaaaacggagagccgatcgtgatgctgaccgcttacgattatccgcaggcaaagcttgcggaacaggcgggagtcgacatgattttagtcggggattcgctcggaatggtcgtgctcggactcgattcaaccgtcggcgtaacggtcagggacatgattcaccatacaaaagcggtaaaacgcggtgcgaaaaatacgtttatcgtaactgacatgccgtttatgtcttaccacctttcaaaagaggatacattgaaaaacgccgcggccattattcaggaaagcggcgcggacgcgttaaagctggaaggcggagacggcgttttcgaatccatccgcgcgctgactctcggcggaattcccgtcgtcagccatttaggcctcacaccgcagtctgtcggcgtattaggcggatataaagtgcagggaaaagatgagcaaagcgcgaaaaagctcattgaagacagtatcaaatgcgagcaggcgggagcgatgatgctcgtgcttgaatgtgtgcctgctgaactgactgctaaaataatagaagaagtatccattcccgtcatcggaatcggagccggttcaaaagcggacggccaagtccttgtctatcatgacgtcgtcggccacggcgtggacagaacaccgaagttcgtgaagcaatacgccaaaatcgacggcacgattgagtcggccctcagcgattatgtccgtgatgtgaaagaacgggttttcccggaagaaaagcattcctttcagataaaccaaactgtgctgcaaggcttatacggaggaaagtaagcgatgaaacaactgacagaaactcaacagctgaaagaattaattgcacaataccgctcagaaggccggacgatcggattcgtcccgacaatgggttttcttcatgaaggacacctgaccctggttgaaaaagcaaacaaagaaaacgatattgtcgtgatgagcatctttgtcaatccgactcaattcggaccgggcgaggattacgaagcatatccgcgagatttaaagcgcgatgcccggcttgcagaacaggcgggagcagatgttttgtttacgccgtctccgagtgacatgtataagggcgagcaaaatgttgccgtgcaagtgaaaaggagaactgacgtgttgtgcggcgtctcccgcgtcggccattttgacggagtggccactgtgctgacgaagtttttcaatctcgttaaaccgacccgcgcctacttcggcctgaaagatgcccagcaggcagcggttgtggacggattgattgaggatttctttatggatatcgaattggttgcagtggacacggtcagagaagaagacggacttgccaaaagctctcgcaacgtctatctgactgagcaggaacgcaaagaagcgccgatgatctataaagcattgcagcaaggtgccgaactggtcagagacggtgaaagaaatccggaaaccgttataaaaaccgtcaccggtatcatcgaaaacacaagcggcgtcattgattatgccgaactgtacgcttatccggagctgactccgcttaaaacattaaacggcaaggtcattctggcctgcgccgtccaattttctaaagccagactgattgataatatcattattgatattgatgaatgggagagatcataatatgtaccgcactatgatggccggaaaactgcaccgcgctaccgtgacggaagccaatttaaactatgtcggcagcatcacgattgatgaagatcttttagatgccgtcggaatgctcgctaatgaaaaagttcagattgtgaataataacaacggagcgagacttgaaacgtatattattcccggtaagcggggagcggcgtcatctgtttaaacggagctgccgcccgtctcgtccaagaaggagataaagtcattattatttcttatcaaatgatgtctgatcaggaagcaaaaagccatcagccgaaggtggccgttctggatgatcagaataaaatcgagcagatgctgggccaggagccggcacacacgattttgtaaaagagccccttcatgggggttttcttttaagatttaggggcaaaagctgtttttccgctccatttctcaacaaaacgtgttacacttttctcgtatgcaagaattgaggtgtccattttaatgaacaaacaacggttcgttgtcatagatgtcgaaacaacaggaaattcgccgaaaaagggcgataaaatcattcaaatcgcagcggttgtcattgaaaatggacaaataactgagcggttttcaaaatatatcaatccgaatcaggccatcccgccgtttattgaacagctgaccggaatttcgtccggaatggttgaaaatgaactgccgtttgaagcggtcgcagaggagatttttcatctgcttgacggcgcgtattttgttgcccacaatattcatttcgacctcggatttgtccggcatgaactgagcgaagcgggctatgagctgccggattgtgaagtgcttgatacggttgagctttcgcgtattgttttcccggggtttgaaggatataagctcggtgagttgtgcgcagagctgaatattgttcatgaccgccctcaccgcgcagacagcgatgcggaggttacgggcctggtctttttagacattttacataaactgaaacatctgcctttaccgacgttaaagcagcttagaaggctttcacagcattttatcagcgatttgacgctgcttttggattcttttattcatgaaagcaggccggcggaagaaaagagctgcattccatacgcctctttttcaattaaagagcccgatcacattccggtttcccgtccggtgaatgcggccattgaccttgaaaagtggaacgaagaaaaagaacagatcttgtccggcatcatccccgctatgaaaagcggaaaggacagcttacgatgatggatgaagtgcttggcgccttccgcaatcgggagcatgcgctgattgaagcggcgcccggcatcggaaaaacgatcggttatctcgttccggctgttttatttgccaaagcggaacaaactcccgtcattatcagcacgtactctactcttttgcagcagcagatcatgtctaaagatcttccgcttttggagcgtatgtttccttggccggtcaaagctgctattttaaaagggaaatcacattatctgtgcctgccgaagtttgaacatattctgcatgaggaagatgacaactatgatgcggttttgacgaaagcgcagcttctcgtctggctgacggagactgaaacgggcgacgccgctgagctgaatcttccatcaggcggcagattgctgtgggagcgcatggcttacgatgagaattcttttatgaaaaaagggaaggactcggctgccgggttttatgaacgggctaaagaaaaagcgcaggccgcagatctgattatcacaaaccatgctttgctgttttcagatcaaagcagtgaaacgaaaaaactgcctgcaagcggaacggtcatcattgatgaagcgcatcatttcgaacgcgccgccagcgagcacctggggaagagagcttcatacatcggactgcacacaaagctcagccgaatcgggaccttaaaggaacacggactgttaaagcggatgagaaaactgttttatacgtatgaactgccggcggaaagtttttttgacgccgatgagtggatgaagcatattcaatcggaaagcgacgcatttttcagttcagtgcattcttttgtcaaacgaagaaaacctaaagacgatctgaaccgtctcgtctatagtctcaatcataaaagccaggataaagggtttcacatgataacggacggagcggagcggctttgtgcgatgcttgatcagctgcttgacatgttttccgtacaggagaaactgttacatcaaaagcttgatcagatgaaaagcggagcggcttttttagcgggcgaatatgtaaagtgtatcagggggctgaaagaatatcgcgatacgttcagcaggctgctgtttgaaaatgatgagaaagaagccgtttgggttgaaattgatgcgaagggcgcaaaaaatgccgtcagcatctatgcgcagcctttggagcccggtgaaatgctggcagaccagtttttcgcccgcaaaaaaagcgttgtgctcacatcagcgaccttaatggtggagcagtcttttcaatttatgattgaaaggctcggacttgcggatttttatccgcgcaccaaaagcatcccgtctcctttttcttacgatgatcagatgaacgtcatcattccgaaagagatgaaatccgttaaatatgacggggagcgggaagtcattgagcatattgccaagtatgcagaaatcatgtcaaagggaaaacagccgaagatccttgtcctgtttacgtctcatgatatgctgaaaaaagtgtatcaggaactgaaactcagtatggagatctcaggcattcagcttctcgcccaaggtatttcaggcgggagtcccggtaaattaatgaaaacctttaaaacggcaagccggtcgattttgctcggaacgaatcatttctgggaaggcgttgattttccgggggatgaattgtcaaccgtcatgatcgcaagacttcctttcagggcgcctgataatccgcttcacgccgcaaaatgcgaatttgccaagaagcaggggaaaaatccgtttcagacgatttccctgcctgaggccgtgttaacgttcagacaggggatcgggcgcctgctccgtacggcgggagacaagggaacgatcgttcttttagatcagcgtgtaaagacggcgggatacggacggctgtttcttgaagcgctcccgacttcatcccttttggagctgacggatgccgaactcggggcttatgtcagccaaacggaataaaagccgcataaacgcggctttcgtggtgtgggatgaggaattgtttttatagtaaaagcgggttcatgccgccttgtgattttattatgccgcgggcgcatcccgttatgactaacaaaatttgttcgaccgatggagggtataaaaatggaaagcaaaattgaaattctgtcaacgattaatgtggagcattcagatgatttatataaaatcgtcgatacattaaaccggactttgaaacgggacaacctgatgttcggccttgcgctcgacgaagaaaatcaaaatgaagcggtcttcaccatttatcgcacataggtgaaaaagatgagaaaaaaagcattaatatttacagccgtatttggtattatttttttagcagttcttttattttcggccagcatttttaaatctgcaatggctcaaaaagaagaaggccacgaaacagctgccgcagccgctaaagaaaaaacgaatctgacagacgctgagaaagtggagacctttgtcggcaaacagaaatattatgttgttaccggaacggataaacatggaaaagatatgtatgtatgggttccggccgacaaaaaagcaaaaattctctcaaaaaaagccagtgacggcatttcaagcggcaaggctgccaagatcgttcgggacgaagggcttgtttccaagctgaatggcgttcacccggcgagagaaaacaatgttccgttatgggaagtgacctatatcaacaaaagcgggcagtatagctttagctatgtggactttacaagcggcaagattctcaaaaacatcacaccgtgagacgtattaggggagttcaagttgaaattggcaaaaagagtatccgcattaacaccgtctgcaacacttgcaattaccgcaaaagcgaaagagctgaaagcggaaggccatgatgtcatcggcctcggagcaggagaaccggattttaatacgcctcagcacattatagatgccgcggtgcgttccatgaatgaaggctatacgaaatatacgccttcaggcggtctgccggccttgaaagacagtatcgcaaaaaaattcaaaaacgatcaggggattgaatataagccgtcagaaatcattgtctgcactggagcgaaacacgctctgtatacattatttcaggtcattctcgatgaagggacgaagtgattataccgactccttactgggtcagctatcctgagcaggtgaaactggcaggggggcgtcccgtctatgcagaagggctggaatccaatcagtttaaaatttcaccggagcagctgaagcaggctatcaccgagaaaacaaaagccctcattatcaattcaccgagcaacccgacaggtgttatgtatacgaaggaagagcttgcggaactcggaaaagtgtgtctggagcatggcattctgatcgtttctgacgagatttatgagaagcttacatacggaggaaaaaaacacgtctcaatcgcacagctttcagatgaattgaaagagcagacgattatcattaacggcgtttcgaaatctcacagcatgacgggctggaggatcggctatgcggcgggttcggagacgattattaaagcgatgacgagccttgcgagccacagcacatccaatccgacgtccatcgctcaatacggcgccattgcggcctataacgggccggctgagccgcttgaagagatgagacaggcatttgaggacagactgaataccatttacgctcagctcagtgagattcccggattcacctgtgtcaaacctgaaggggcgttttacttgttccctaacgccaaagcggccgcagaaaactgcggattcaaagatgtcgatgaatacgtcaaggcgcttctggaagaagaaaaagtcgccatcgtgccgggctcgggtttcggttcaccggacaacgtccgcttatcttacgcaacgtcactcgatcttttagaagaagcggtcaagagaatccgccgctttacggaaaaacacagctgattctgaaaaagcggcttttaaagccgcttttcacttgcattgaccccgttagagtagaacgggtataataaagtgatgaaaaaagagattcaggcagattcctgaatgtctttcttgttctggagggaaagagtttgaaaacaacaatcaaccaagtgtataaacacacaggcgaggaagtaacgattggagcttgggtcgctaataaacgctcaagcggtaaaatcgcatttttacagctgagagacggtaccggcttcattcagggagttgtcgtcaaagctgaagtagaagaagacatcttccaaattgcgaaatcagtgacgcaggaaacgtcactttatgtaaaaggaattgtgaaagaggacgagcgttcaccgcttggctatgagcttgctgttacatccattgaagtcattcacgaagcgactgattatccgattacgcctaaagagcacggtacggaattcttaatggatcacagacatttatggctccgttcgaaacgccagcacgcgattatgaaaatccgtaacgaaatcatccgtgcgacttatgaatttttcaacaaagaaggcttcgtgaaagttgatccgccgattttgacgggaagcgctcccgaaggcacgactgagctgttcgcgacgaaatattttgatgaagacgccttcttgtctcaaagcggccagctgtatatggaagcagctgcaatggcgctcggaaaagtattctctttcggaccgacgttcagagcggaaaaatcgaaaacgaaacgccatctcatcgaattctggatgattgagcctgaaatggcatttgttgaatttgaagaaaaccttgaagttcaggagaattatgttgcatacatcgtacaaagtgtgctggaacattgtaagatcgagctgaacacattaggaagagacacatcgaagcttgaacaaatcaaagcgccattcccgcgcattacgtacgataaagcgattgaattcctgaaagaaaaaggctttgacgatattgagtggggagatgacttcggtgcgccgcatgaaacagcgatcgcagaaagctatgacaaaccggtgtttatcactcattacccgacgtcattaaaaccgttctatatgcagcctgccaaagatcgtgacgatgtcgtgttatgtgccgacttaatcgctccggaaggctacggggaaatcatcggcggttcagaacgcgttcatgatatggatttattggaagaaagattaaaagaacacggtctggattcagatgcttacaaatggtatgctgaactcagacaatacggttctgttccgcactccggcttcggtctcggacttgagcggacagtggcttggatcagcggagcgcctcacgtgcgtgaaacgattccgttcccgagacttctgaaccgtctgtatccgtaatagttatgaaaaacgaagtctcctgcaagggagactttttctaagtaaaggggaaagctcccggagataaccttttacagtaagaggtgtaaggatgaaaaaacagcaatttatagatatgcaggaactcggcatttcaagcattcccaacctgctgctgacacattaccggcagctcgggctgaatgaaaccgaattgatcctgcttttgaagattaaaatgcatttggaaaagggctcttattttccgacgccgtttgaacttcaatcaggcatgtccatctctgctgaagagtgtacaagctgcctgagaatgtttattcaaaaaggttttctgtttattgaagaatgtgaagaccataacggcataaagtttgaaaaatattctctgcagccgttatgggcgaagctgtatgattacatgcagcattctcaaaatgaaacgcaggaaagaacgtcagaaagagaacaaaaaagcctgtataccatctttgaagaagagttcggaagaccgctgtcgccgcttgaatgcgagacgctggccatatggcaggatcaggatcagcatgatgcgattctgattaaacacgccttaaaagaagccgttttatcggggaaactcagttttcgctatattgaccggattttatttgaatggaaaaagaatggcttcaaaacggttgagcaggcgaaggcgcacagccaaaaattccggcgtgttcaaacgaaacagaatgatccgcaaaaagagtatacgaggcaggtacctttttacaattggctggaacaataacatgagaaggggagaaacgtgttaaatttaaagcagattgaatattgtcttgaaaaaatcggcgatatgtttccgcacgcagaatgtgaacttgtccattcaaatcctttcgaattggttgtggcagtcgcattatccgcgcaatgtacggacgctctcgtcaacagagtgacaaaaacgctatttcaaaaatataaacggcctgaagattatcttgccgtatcgctggaagaactccagcaggatattaaatcaatcggtctgtaccgtaataaagccaaaaatattcaaaagctgagcaaaatgatcattgaagagtacggcggagaagtgccgaaagaccgggatgagcttgtgaagctgccgggtgtcggacggaaaacggcaaatgtggtcgtgtctgttgctttcggcgtacctgcgatcgcagtagacactcatgtggagcgggtctctaaacggctcggcatctgccgctggaaggactctgttttggaagtagagaaaacattaatgaaaaaagtgccgaaagaggattggtctgttacgcatcacagattaatatttttcggccggtatcactgtaaagcgcaatctccccgctgtgcggaatgtcctttgcttccgctatgcagagaagggcagaagcgtgacaaaaaagggctggtgaaacggtgacggcgattgacattctggcaggctatgaaacatacctgcgcagccttacggacttggaaagcctcgagatcaaagcggcgctgcgccgccatccgctgtatatggatttcagcggccagccaacagtgcagccatggagggaaaggggcgaatatgtcccgtttctttttcagatttggaatgaaacgaaagaaacgctgcttcccgtttttcaaacaagaaaatcgaggtgtgatcaaaatgacatgctgaagggaatagcctgtctgattgccgcttttcattggacggcaggggagcgggtcacatcactcgactggactgtgcttgaaacaaagcattttcccgcggaaccgatcaattgggcggagcgaatggcgtttattttaacaaaaccgactcaatatcactcgtttattcagctggatgaattgatgacggagatgaagaaacaatatcataaatatgaagccatgaacaaatgttaaaaacctccttttcccataaggaggttttttgtacgaaaaaaatccttcacctgtttggggtgaaggatttcgtccgctaatgagcgggatttgactggatggttgacgaattggactgcccgttgatagttgaagatgagtcttggtttttatccgtttgaccgctgtcaggtttatttgagccgtctgaaccggaatcggaatcattatcagagccgttatcttgctgtccgttgttatcggtcccgttgccgggctgattctgattgttgttatctgtttgatccttatcggattgatcctgatttttatccgggtcatcagttggtgtttgatccgatccgtcagacgtatctgtctgatcgtcatctttgtttgaatcatcggtttgcgtcttgtccttatctttatcttcatcagtcttctgttcatcgtcagtcgctttatctttatccgcatcgtcttcttcatctttcgggactttgaaagatgctgatgccgtatcgctttttccgtcatcgttttccgctgtcacctggaagctgtatgtggagcctggcgtgacatttgagacgacggcttcttttgccgaactgttttgaatgtcactgtagcttccgccgtcaacggattgtttgacattgaatgttgcatcaccgtcataatcccagcttaaggttaatgattttttatctttgtcgtatttcacttgcaatcctgtcggtttatcggctttttctttcgtgtacgttttagaaacggcagttggctgcgttcctttcacgaagtactccgtcacttttttatcatccggcgtattcggtccggctaaagcggcaggattcgagcctttctcaactgtttcttttacaacgctgtcaggctgcttgaagcttcctttaccgtcatcaacgtatgagatcagcttttggaaaatccgttttgcgacttgctggtctgcagaagacagtgatttcttgcctgctttgttgccagactcaactccggtccaaaccgccgctgtatattgaggggtgtatccgacaaaccatgagtctgggactccgcctggagcaatgttatatttttgaatgtcctctttagtaaagttggtcgtacccgttttaccggcgacttccacgttcgccacctgagccagtttacctgttcctgattcgacagctgatttgagcatatctgtaatcataaacgctgtgtagtcgctcatagcacttttcggtttcggtgttaaatcaagcttagtgccgtcattaaattcaatcgatgtgaccgcgtgcggttcgttgtacgttccgttatttccgaacgcactgtaggcgcctgccatggtcatagtagatacaccgcggttaccctcaccaaatccccgatagagtagggttcatatacttgatctttgtttaatcccaatcctaagtcgtttgcgaagtcgacggcatgatcttttcctgctgcttggtatgcttttaaagcaggaatattacgtgagtctgcgagggcctctcgcattgatatctggcctctgtatttattgtcccaatcatgaatcggtgtgccgtcagagtacgtataagctgagtcgtcaatctgttcatacgtcgaccattttttattttcaatgaccggtccgtaatcaagaatcggttttatcgtcgaaccgggctgggttttaccttgtgttgcataattgaatcccccggtagttctgttccgtcctgccccgatggcgcggatttctccgtttgtcgtatcaaggagcgtgacgccgccctgcatgccttcggtaaatccggctgtatcgccgttcatcaattgatcaagataatcttgtgctttcgtatcaagagtcgtgtaaattttcagtccgtcagttgaaatatcgacgtctttcttttcttttgtctcaatttctttcataacttcttcgacaaaagcgctgtatttatttgtgtcctttttatcgtattccttttggctgacgacgccttcatctttcatggacactttcttcgctttttggtattcagagtttgaaatgaatccttgtttttccattaagctgagaacgatgtttcgtcgtttttcggaagccttcgggtttttaaccgggttatatccggtcgggctttgcggcattccggcaagcgttgccgcctgttcaaccgtaagcttgctcaagtcttttacgccgaagaattcttcagccgcttttccgacgccgtaggcgcgcggtgagaaataaattctgtttaaatacatttctaagatttcatctttagaataatggcgctccagctgcagggaaagccacacttcctgtgctttccgtttaatcgttttctgatgggtcaaaagcgagtttttcacaacctgctgggtgattgtgcttcctccctctgaaccgaacccatccgtaaagttggcgaccaaagcgcctccgatacgaatcgggtctataccgtggtgcttataaaaacgggcgtcttcagttgcgataaatgcttctttcacaacatcgggtatatccttaatcgggacgtaggttcgtttttcaccgcccacttccgcgatttcttttccgtttttatcgtaaatcgttgaagagtaaggcgttttcagcttggcttcgtccaaagacggcgcgccggaaaccaaaacggcaaatgccgccgctccgccgactatgccaaggacaaacagaataaccaaggacagcacaatctttttgaataaaccgcctttacgctgtttcttgccttttttcggtgaagagggcttagtgcttttcgtctgccttgccttacggcgttcttcacggctcgtaaattgatctgacataacatctcaacctttcgtttatcaacctttcgctcagtctactgttcctgcgaaaaataaagctgttcaataatactaatataatcaattctcggtgagtatccaagggaaatcggaaaggaagcatcttctaattcgtctttgcgaattgattttctgccgttcttctcctttctctcccaaaagacaaacagcttgtcggcttcgaggaaataaacctttccgaaagcggatataataacaaaacaaatgccgtcttgcctgaccacctgcttcatatgctcaatctgatgatcatgaaaattctgcaggggaaatgccgttttgttttttgtttcttttgcctcgaaatcgatgtagcgtcctttataaatgccgttgtagtcagttgttgaagactgtttaaaataagcttccttaatgactgcggcgcttcttttcggatagtggacgtttacaatctggacgggtgtcggctttttgtgaatgacagcaatttggttagccagataatacttattcgtttcattcaggtcgtcttcgagggtcatgccgcgattactgtatgaatgagaccgtttctggctgttttgggatgaaaccgttttgttcggctgaaaagtttttccattcgggtaccgaatcactttttccatcctccttatcaaactaatagtgacggaagtgaatgaacgtgcataaacgacagaccgtaaccgccattcttcgcctgatcgaaaaagagacgaaaataaaaaatgccgataatatttcccggacgaatgcctataaagcatattatgaccgccatcctgagatcaagtggccgcttttggcatcctttgtgtcccgcaatgcgggctggtcgatgactgatttaagaggcgtcctttatcaggagggccttgacagcagtcagaaaaactggtttttcctttcgtatgaaagggcgaattggctgattttttctgatgcctatcctcagcttctggtctaccagtggtcaaaacaaatcggcgaacctcttttccgtcatcttccttatttccgcgtctcggcttttatgcaggaagaatggttccgcttttggcgtgacggagatacggaacggctcatgtatgctcttattataaatgaacaaaacactatccaagcacctattatacaaaatccttcgtttaaaaagaatgtttttggcacgattcctttttatttaagtgattggtttcactttaatacggtgatattcccttcatttgacggacatttatacggaatttccgtcaaacggttttcaaaaaccgaagagagaattacgctcggaaaacagctggcccgccttctgttcagccctgatcttcacgcttctttttaccgttttcttgataccgttcctcataccggttcacgctttgatatggagaaaatgatcggcatcaaaaaaagaacatcaccgatgcttaggacaacctatcccattgttgcccacccattagacggcgaaagggcggattggtttcaaaaaaggttaagaaaaggggctttcttacaggagaaaatgccgaaacagcttgaactgacggactggtacttccagaaaagacgggagctccatgcgctcttcgcggttaaagagtggctgaagaaatgaaaaagcccgaaaccgttcgctggggtttcgggctgctgatgtgttacgtggaagggcggtttgggccgcctaattttttatcaagcgtatcagtcgtttttgcttcggttttttgctgtttacctgcatttttcggtctcgttttcatacggcacctcctcaactgtatcgtttgcattaacgtgccggttcatacaaagtttgcggcacttttttgtcgaaaggcacgccttttaggataatctctgtttgtttgccgaactgcttctagttttgtcatgtgcagaggagagcggtatgaaaacgagaattatatttgaaagagatgcaagtgataaaagggaggaacatgaatgtctgtttacacgagcaaggctgatattctccgtctgctttctgatatcgaaatccggatttctgctgctgaaaaaacgcttacccaagcagtcagatgctgtcaggcggaagctgaagaaatcagacaggagaaactttcccgtcttgaggaagaggcgcgggagcttcatgtttgtattgatgacctgtttttgactgaccggcgtaaaaaggatttgccgcgagtctgccggataagctgattttgtgcaaaaactttggtaccatatgtactgaggtgagtccgtttgcagacacagtcgttattggagctgacagaacaaatgatagaggcggttctggaagccgaaaaaaggtatcaggatggaaaagagtcaggccgttcatatgatttttttgagacgattaaacccgatgttgaaaaaagagaccggctttgcgcgctttggacagaagcagcgcttgcgtttattcaggaaaaccgtccgaaatacgttcatcatgcacaaattcaggccgttacagaaaatttcggggagctgatgctccaatcatatgttcatcatattcataaaaaaagatacagggatttaactgaatctgttttatatacgcttcgtatattaagggatgaaattgaaaaagaaggcagctgaaaacggctgccttcttttatataaaggggtcgggtatgttattcatacgccgggttttctgctccacttgcttcgagaaccttcatactgtttcgaaattcggttgcggtgagatggccttgaatatagaggaattttgcaaagtccatcagtttatctgcacaatctgtttcatattttttcacttcagcaaaacgctttcttaagtatgatacgttcataatggtgcatcccctctcatgtatgttgagattatgttaacataacgattcgacttttttctgtttttaaaaaattaagactttcgacagcatttgacaaagagcagaatcaccgaaagcacataaccaaggcggaattcatacatatatagcagaaacttagtgagagacaagggggaatgtcatatgcaatggagagcgcagccatatcaaaatatgtaccagcagccggcgggatatttctacccgcagcagatacagccattacagccgccgtatccgcagcagatacagccattgcaacagccgccatatcatcagcaagggcagtacccgcagcaattttatccgaatcaggaatacggtcatatacagcagccgtttgctcctgctcctcctcaggcaggcatgcccgggggccagccggggtttgtgaatccttaccccgttcccagaccgaatcagcagcagtcttcccaattctcaggcatactctcccagtttaaaaaaacgaacggacagtttgactttaataaaatgatggatacaacggggcagatggtaagcgccgtaaatcaggtcggatcgctggtgaaaggcttcaccagtatcttcaaataaaaagcatgaatgatatccatcattcatgcttattttttagggaaaaagaaggtaagcgtctgttcattccaggatgtttccatatcttcttcacttaccttatacgggaggacaacggttcttgtcatgcttgaagacacatgggatgattgagcctgtttatgatcgtagcggattgtaacgtgaaggtagcaccctttcgtttccaccagcatatccccgtcacggaacgtctcgggaacgccgatatcaaccgcgagccccgtcggctcttctctgacgtcaatcgtcacttgcgcttcagtaaaagccgaattgacaaggtgctgaaaaccctgcatcaattctgcgaagggacctgagtgaaaaaattggtccatcgcatggctgatgatgtcctcattactttgcggatcaagtttatcgttttgggattgatccatatgaccaccgcctttttacaaacagactatgcgatgctatgccgtatggttaagaattgaaggaaaaaagaaagtatggttaaatagtggagaataaactggtaacggattcacatttaggaaggggagcacaacacattgctgaaaaaattattcggattgggagacagccggaaaaagccggccgaggaagtgattttttctccggctgacggagcggtgatggatttggcttcagtgccggatcctgtattttcacaaaaaatgatgggggacgggatcgccgtcgagcctgcaaacggagaaattgtttcaccggttgagggagaagtgattcagctgttccatacaaaacacgctgtcggcatccgcaccctttccggagcggaacttttgatacatgtcggtttggataccgtcaatatgaacggcgaaggctttgaagcgcatgtaaaagaaggagacaaagtgaaaacaggcgatctgcttttaacgtgccggctggatttaataaaagaaaaagcaagcagcaccgtcatccctatggtgattatgaatggcgatgccgcagaacctttgcaatttgcaggcgcaaatgaagcgaaaaaaggacaaacagagctttttacgataaaaatgaagtaggcaggggctgattccctgctttttttcttgtgcaggattttcatctagccaggcaaacaaatattcggtaaactgtacctcataaagaggtgtgaacgatgaagaaaaaatcactgagcgaactgattcaggaattaaaaaatcatgaaaatattgtgcattggcatgaagaggaaccgcgggaggcgaaaacgatgccgatgccggagcaagtagatccgaacattcgggcggctctcgaaaagagggggatcgagcggctttttacacatcaatactccgcttttcagacggttcaaaacggagaaagcattgtggccgtcacaccgacggcctccggaaaaacactgtgctataatcttccggttcttcagtctatcgcggaagatgccacaagccgcgcactttatttatttccgacaaaggcgctcgcgcaggatcaaaaaagcgagctgaatgaaatcatagacgagacgggcatggatattaaaagcttcacctatgacggagatacgtctccggctatcaggcagaaagtcagaaaggccgggcatattgtgatcacaaatcccgatatgcttcattcagccattcttccccatcatacaaaatgggtgagtctgtttgaaaacctgaaatatatcgtcattgatgaattacatacgtaccgcggtgtattcggcagccatgtggcgaacgtcatccgccgtttaatgagaatctgcgctttttacggaagcaagccgtcatttatctgtacatccgccacaatcgccaatccgagggagttggcggagcagctgacgggaaaatctgtgcgcctgattgacgacaacggtgccccggcaggaagaaagcactttgctttttacaatcctccgattgtaaataaaccgctgcatattcgaaaaagcgccaccgtggaagtgaacgaacttgccaaaacttttttaaaaaataagatccagacgattgtttttgccagaagccgtgtccgggtcgaaattattttaagccacattcaggagatcgtaaaaaaagaaatcggcgcgaagtctgtcagaggctatcgcggcggatatctaccgaaagaaagaagagaaatagagcgggggttaagagacggcagcattctcggcgttgtcagcacaaacgcactggagctcggcgttgatatcggccagcttcaggtctgcgtgatgacggggtacccgggcagtgtcgcgagcgcatggcagcaggcgggccgggccggacggcggcagggagaggcgcttatcgtgatggtggcgaactctgatccgattgaccaatatattgtgcgccatcctgattatttctttaaacgctcgcctgaatctgcaaggattaatcccgataatctcattatattggtcgaccacctgaaatgcgccgcatatgagctgcctttcagagccgatgaaacattcggagaaaatgatgcgagggacattctcgagtatttagaggaagaaggggtgcttcacgaaaaccgcgaacgctatcactgggcgagcgaatcttttcccgcctccaatatcagtctccgttcggcgtcacaggaaaacgtggtcatcgttgaccggtcagagacggctgatgtaaaaatcatcggagaaatggaccgcttcagcgcgatgacgcttcttcatgatgaagcgatttatcttcatgaaggggtgcagtatcaggttgaaaagcttgattgggaacataaaaaagcgtacgtgcgaaaggtcgatgtcgaatattatacagatgccaatttagcggtgcagctgaaagtgctggacattgacagaacggacagcagaaagaaaacggccttacatttcggcgacgtcaccgtgaacgcacttccgacaatatttaaaaaaattaaaatgacgacatttgaaaatataggatcaggaccgattcatcttcctgaagaagaactgcataccagtgcagtctggcttgaattaaaagaaacggattcggaaatcggcgaaaaaacgcttgaacagctgcttttaggcattgcccacgtcctgcagcatatcgtgcctgtatacgtcatgtgcgatcgaaatgacgtgcatgtcgtgccgcaaatcaaagccgcacatacgggacttccgacaatctttctgtatgatcattatccgggcggaatcggacttgccgatgaagtatataaacgatttgatgaaatcaatgaaggggctgagcgcctgatccgacaatgtccatgtcaagacgggtgtccttcctgcatcggctccgaaatagaaggaatagatgcaaagaaagcgatactccggctcttgaattacgtgtaaaagaaaagggggacgaaagatgtccttgaaaaataaattaaagcggatgaaaaaccacctgaatgtgccggaagctgaaaaaaagccggcagcttcacaactttcggtcccggatattcaagtcccgtttagagaagaatgggaggcattcggagtgaagcctttcttttttgaggatgaatactgtcttatccgcgaaaccgtctatccgctttcgcaccgccacggacggtacagcttcagtgaacttgatgacgtcatggcattatggaataaaggcggtttgacacatactttatcagcagaaggatacgaaaaaagccagctgttcttctttgatactgaaacgaccggcctcggcggcggggcaggcaatatgatctttttgctcggccatgcaagagtgtatgaagaccgtgtcgcggttaaacagcatctgctccctaaaccgggaaacgagacagctctttacaaaagctttttaagtgaggttgacattacgtcccttgttacgtataacggaaaagcctttgactggccgcaggtaaaaaccaggcatacattgctgcgggacaggcttccgaaacttcctgacttcgggcactttgatcttctgcacggggcgagacggctttggaaacataaattagagcgtgtatcgctttcggcggttgaaaatgaagagcttgcttttaaaagggacgaagacacccctggttatttggcgccgatgctgtattttcaatttttaaaggcggaggacccggctcttttaaagggagtgctctcgcataatgaacaagatgtgctttccctcatcgctctttacatccatatgtcaaaaaagatttttgcatcttctgatcagacgtcagaacgtcaggaagcatacgccatggcgaaatggtttatcgctcataaagaaaccgatcgcgccgttttgcagctggaagcgctgcaaggcaaagactttgaagattcggatcgggccctttttgacttagcgatgctttataaaaaacaaaaccgcaggcaagacgccgtgcccctttgggagaaactgacggactctgatcttcacacatgcagacaccaatcagcggttgagctggcgatctattttgagcaccatgcaaaagattacaaaaaagctctgcaggccgcgcagcaggcggcagaagacggggaaatatcggaaaaagaagccgagaagctccatgtgagaattgcccggctcaagaggaaatattcctcttgaaatattgcccgggaaagcgcaaaagccgagctgtttcgccaaaaatatttttttctgaatccgcatcgattttgttgtagaatggtgccgcatcttgtaaaatagcgttagttatttataggggagagttggtatgtataaaggtgttttttacttgttctttgtcgtggtttttttgattgcgtttgtattttcgaattttaaagacagtttgctgacacacttttaaattgggtgattgaattagaacatgcaccctcttttcttcataacctaacagtgtaataaaagttaatggagaggggatttagcatgtttcatcatcattgttgcagaccaaacgtgatgccgccgattgtccatccgactcattgctgtgaacaccattgcttttctaacacggttgtgccgcatattcatccgcaacatacaactaacgtaaatcaccacaactttgagcacgttcattactatccgcacactttttcaaatgttgacccgacaactcaccagcattttcagtgcggaagcccttgctgcgatcattagtattgaacgcttaagcaagatcggttaggatatcagcaaatcaaaatggggcccgatggggagccccattttttaagcaggtgattaattgaaagtattagccgtaacggggtacaagccgtttgagctcggtatctttaaacaggatgaccgggcgcttgtttatataaaaaaggcgatagaaaccagactcagaagctttattgacgaaggcttggaatggattctcatatccggacagctggggactgagctttgggcggcagaaacggcgtacgatctcagagaagagtatccggaattaaaggttgccgttatcacgcctttctacggccaggaggaaaagtggaaggagccgaataaagaaatgtatgaagcggtgcttgctcaggcagattatgaggagagcctgacgcatcggccgtacgaaagtccgctccaattccggcagaaaaacgcgttctttattgaaaagtcagatgcgcttttgcttttatatgatccggaggtggaaggatcgccgaaatatatgctgcagcaggcagaaaaacgccgtgaaacagacggatatccgatttattcgattacgatggatgatctccgtgccgccgttgaggaagaagatttctttacataacacgtcagagaatatttgacaacgggacgtgtttctgaataaaatataacatgatgattcacgatatgaggtgaaaaagatgcttgctgataaagtaaagctttctgcgaaagacattttggaaaaagaatttaaaacaggcgttagaggttacagacaagaagacgttgacaaatttttagatatgattattaaggattatgaaacctttcatcaagaaattgaagaactgcagcaggaaaatctgcagctgaaaaaacagcttgaagaagctagcaaaaaacagccggtgcagtccaatacgaccaactttgatattctgaaaaggctgtccaaccttgagaaacatgtattcggcagcaaactttatgacgaataaggcagatgcacttgtcaaatgagacaagttgctttataatgaacaagtgttcttaacgttcgggtaatcgctgcaggtctttgaatctgtagaggaaagtccatgctcgcacggtgctgagatgcccgtagtgttcgtgcctagcgaagaaataagctagggcagccttgataggctgacggcaggaaaaaagcctacgtctccggatatggctgagtatccttgaaagtgccacagtgacgaagtctcatcagaaatgttgagagtggaacgcggtaaacccctcgagcgagaaacccaaattttggtaggggaaccttcttgaaggaactgaacagatagaaggacagaatactttctgtagatagatgattgccgcctgagtacgaggtgatgagccgattgcagtacgacggaacaaaacatggcttacagaacgttaaacattattgatatgacaaattagagctctcctttaaaggggagcttttatcttgaatgaaacgaaagcttaaaagagacagggtgatacgatgaagaagtacacactaatagcgacggcgccgatgggaattgaagcgatcgtcgccaaagaagtgcgtgatttaggttatgaatgcaaagtagacaacggaaaagtcatttttgaaggagatgcgcttgcgatctgccgcgctaacttatggctgcggacggctgaccgcatcaaagtacaggtcgccgagtttcaggcaaaaacgtttgatgagctgtttgaaaaaacaaaagcgattgactggcgcgcgtacattccagaaaacgcaaagttccccgttatcggaaagtccgtgaaatcagtgcttgccagtgtgcctgactgccagcggatcgtcaaaaaggcgatagcgggaaagctgaaacttcaatcaggaaaacaaaatgaatggattgaagaaacgggacccgagtataaggtggagatttcccttttaaaagataaagccgtacttacactggattcatcaggaacaggccttcacaaacggggatacagggttgatcagggcggagctccgattaaagagacgctcgctgccgcgttaattctgttaaccaactggacgcctgaccgtccgttcgtcgatccgttctgcggttccggcacgatcgccatcgaagccgctttaatcgggcaaaacattgctccgggttttaaccgtgattttgcttcagaagactgggaatggatcggaaaagaactgtgggacaaggcgcgccttgaagtggaagaaaaggcgaactatgatcagccgctgcagatttttgccagtgacgtggatcaccggatggtaaacatcgccaaagaaaacgcagaagaagcgggacttggggacctgatcgaatgcaagcagatgcgagtgcaggattttacgacgaaactcgaattcggcgttatcgtcggaaaccctccgtacggcgaacggctcggcgaaaaaaagcaagtcgagcagatgtataaagaaatgggccgggcatttgaatctcttgatacatggtctgtctacatgttaacgtcaaatgaacaatttgaagaggtctacggaagaaaagcaacaaaaaaacggaagctctttaacggttttatcaaaacggattattatcagtactgggctaaagtgcggccgcagcggaaaaagccgcaacaaagagaagacgcctgatacagcgtcttctccggcatctttacgttttattctgccattaccagcggtgcgcttttgcgttgctccgtaaaataatgttggtctgggacatttcggtgtggccgttcacctgcgatttagagcgtttcggccgcgtccaattgtgatgaaacaattcagaatgctgatctaatcgatctttataactcatgtaaccatcactcccggatagaataattttgtgaagatggatattcgatcgaatatctgttgtagtttgtgcaggtcaggtgcggatcattcaggatggcatgtatagaaagtgaagcatcggcatagaatgatgattatttctatttgagaggtgatcttattttatgctgaacagcgagcacttcagtaaaatacaaaaggcgttagacgcaactgctttccggctggaggaagccggagctaagttcggtccttccgtcatgacacacgcacaggaagaacttgaaaatgcggtaaaacatacacattcaacagaccatccgttcctatgtacacatatcattaaccggaaatgataatgacaaaaacttggcgaggccaagtttttttgttgtattgaaaagggttaaatgatattatagatggtctgaatgccgaatagttaggggttggagttgggtgacaacatcacgtttgccttttgctttaacaaaagaaaagaatttttacgaagaattgaacaattggattggtgacgtgttttacgatatccttcccgagaaaggctttgaccttcgggatgagcaggtatttatggcgtttcagcttgaacgggcatttaaagagaaaaaggtcatgttcgctgaggcaggagtcggtacggggaaaacgctggtgtatctgctgtttgccatcagctatgcaagatatacgggtaaaccggccattatcgcatgcgccgatgaaacgttaattgaacagcttgtcaaaaaagaaggcgacatttccaagctgacagaacatttggatctgcagattgatacacggctgtccaaatcccatgagcagtatctctgtctgaaaaagctggagaaaacgatgcagcgttctgatgatgaaaagtggctggatctttatgagtcgctgccttcattcgtacacgaatcacaagcgatgcagcgcttttatccgtacggcgaccgcaaacagtacgctgatttgacaaatgaagagtgggcaggcgtcagctatgattccttccaagattgtttaacatgtgatatgagacatagatgcggtttaacactttcaagagatcattacagaaaatcaacggatctgattgtttgctcccatgatttctacatggagcatgtatggacggaagaatcacgcaaaagggaagggcagctgccgcttttgccggatcacagcgccgtcgtgtttgatgaaggacatctgctggaattcgccgcgcaaaaagcgttaacgtatcgtgtgaagcagtcgacgcttgagctgtttttagagcgtctgcttcaaaatgacatcagagaggaattcgccgaactgattgaagatgcccttgccgcaaacgatgagtttttctatgtgctgtcagaggaatcgaaggaaatcgccggctctcaccgattggacatccaaaacgaccagcgtgttaagcgtgcggctgacgaactgtgccgtctgctcgataaaatcggcgaggcgctcgtatttgaatcggaaatgtatacgattgataagtacgagctgtcagttgtagaagaatacgtcgaacaaatggcatattcgctgtcgctgtatcaaaaggatgccatcagctggcttgaaacgcgggatacagactcaacgtttgtcgttatgccgagaactgtagccgaagttttgggagaaaaggtcttttctaaaaagataccttatatcttctcatcggccactctttctgagggcggttcatttgattatatcgctgacagtctcggaatccgtgatcctttatcatttaccgttgaatctccgtacgattacgaggagcaaatgtctgttgcgcttcacggtgacatgacgtctgagcagaaaacagtcgaaacgattgaaaccattaaggagaatgaaggacgcaccctcgttcttttcccttcctttgaagacatgaaggaatttaaagaacaggctgccgcgtgggagctgccgtatccgatttactacgaaggtgacgaagagatcagcagtctggtcgaaaaattccagcgggatgaagaatccgtgctttgttccgtccacttatgggaaggtcttgacattcccggtgactcgctccggaatgtgaccatttgggcattgccgtatccgcctcatgatcctgtgtttaccgcaaagcggaacggagcgaaaaaagatccgtttgaggaagttgatctgccgtacatgcttttgagagtccggcagggaatcggccgcctcatccgttctaatcaggacagcggaaccatatccatttatgcgggcggagaaagtgaacgggtcctggccgaagtcaaaaaggtcttgcctgttacaccgaaaatcgtataaaaacaagagctgcaggaatcttatcctgcggctttttttaatccgggaagttgactttataacggcgttccattagcctgtaattgatagtgaaaagggaggggaacggatatggatgtacatacatatgaaaaagagttttttaatctgttaaaaagagtatcccactatgaagaagctattgcgctcatgcattgggacttaagaacgggagccccgaaaaaaggctctgatgaccgggcggaaagcatcggacagctgtcggctgacgtttttcaaatccagacatccgaccggatgaaagagctgatcgacatccttctcgtgcatgcagaagagctctctgaagatacagtgaaagcggcggaacttgcgaaaaaagattatgatcataataaaaaaattcctgaagatgagtataaagaatatgtcattttaacatcgaaagcggaaacggcttgggaggatgcaaaggcggcctctgatttctctatgtttgctccgtaccttgagaagctgattgattttaataagcggtttatttcttactggggctatgaagatcatccatacaacgcattgctcgatattttcgaaccgggtgttacggtaaaggtgctggatcagctgttttctgaattgaaggaagcgatcattccgcttatcaaaaaagtgacggaatccggcaataaaccggacacttcctttataacgaaaacgtttccgaaagaacaacaaagagacctctccttgtatttcttaaaagagttcgggtatgattttgacggcggccgcctggacgagacggtgcatccgtttgcgacgacaatcaaccgcggcgatgtgcgggtgacgaccagatatgacgaaaacgatttccgcacggcgattttcggaacgattcatgaatgcgggcatgcgatctacgagcagaatattgacgaagcgctgagcggaacgaacttatctgacggtgcatccatgggaattcatgaatcccaatcgttattttatgaaaactttatcgccagaaatcaacatttctggaccgcctattatgaaaaaatggttgaggcttcgcctgatcaatttcaagatgtgaaaagagaggactttgtacgcgccgtaaatgaggcgaaaccgacctttatccgaattgaagccgatgagctgacatatccgcttcatattattatccgttatgaaattgaaaaagcgattttcagcaatgaagtgacagtggaagaactgcctgcattgtggaatcaaaaatatcatgattatttaggcattacgccgccatctgacgcaaaaggcattttgcaggacgtacattgggcgggcggcgatttcggctatttcccttcctatgcgctcggatatatgtatgcggcacagctgaagcataccatgcttgaggatctgcctgaatttgatcaattaatagaacggggcgactttgagccgatcaaacaatggctgacagaaaaggttcatcagcacggaagacgcaaaatgccgcttgacatcataaaagatgcaacgggagaagaattaaacgttcaatatctcattgagtatctcgtcggcaaatattcaaatttatatttataaacgaaacgcccggcatacaccgggtgtttttctaaaaattctaaaaagacgaataatcgaaaactaattctttgtaaaagttcggaaatattcaaatttcactatgcaaaagaagtgtatcttgttataatttgattaatatcatacgaacactcatataatcgcgtggatatggcacgcaagtttctaccggtcaccgtaaatgtccgactatgagtgagcaatggaacggctttattcggccgttacgtgtagatcattcggcattgcttgctctttttttggagagcgggcaatgctttttttattttttataagcgggggtaatcattgtggaagcattaaaacgaaaaatagcagaagacggaatcgttctttctgatcaagtgctgaaagtggattcttttttaaaccatcaaattgatccggttctcatgcagcagatcggccgggaatttgcgcggcgttttgaaaaagacgagataaccaaaatcgtcacaattgaatcttcgggcattgcccctgcggtaatggccggccttgaactcggcgttcccgtcatctttgcgagaaaaaggaagtctctcacgttaacggatgatctgctgacggcgtccgtctattctttcacgaaaaaaacagaaagtcagattgcaatctccggaaatcatctctcgaaagaagaccgcgtgttaatcattgacgactttttagcgaacggacaggcggcagaggggcttttgtccatcgtaaaacaagcaggcgcagcggtttgcgggatcggaatcgtcattgaaaagtcatttcagccgggaagagacgagctggtaaaaaaaggattccgggtcgaatcactggcgagaattcaatcgcttgaagacggaaaagtgacatttgtacaggaggtccgttcatgaaaaacggctatgccaaaacactttccctcggtatccagcatgtgcttgccatgtatgccggcgccgtcgtcgttcctttaattgtaggagcggcactgggactgaacgcagaacagctgacatatctcgtatcaattgacatttttatgtgcggggcggctacgctgcttcaagtatggaggaataaatgtttcggcatcggcttgcctgttgtgctcggctgtacgttcaccgcggtagcgccgattatttccatcggtaaggagtacgggatttcagccatttacggaagcattttggcatcgggtctgcttgtcattctgctgtcatttttcttcggcaagctcgtatccttttttccgcctgtcgtaaccggatctgtcgtaagaattattgattgagtacgacataaacctagttatagtagaccttgatattcaaattcttcgtaccatctcccaaatcctcgaccgtatacgttacatgactaatgagcatctttagtattaagtttatttcagagttagacatcccctcagtagactcaatcatctcctgcactttatgatgactccatttttctttttttgtctcagcgctaagagcattttgaaactcagtagatgcaattaattctgctaaatcattttcagctttttgaagtgtctcttgtgaaattttcagcttttctttgtactctgttttactgatgtccccatctaagtacatttcctttatgcgttctattcttccctttgcctttttaacagctttttctcttaaaccaataagctgagttgtataagagtcatcattaacatcttgctcagtaggggagaagagagcttcattgtatttttttatttccttcataattgactggaacaatacttcttcatgaattccttttgtttcttcgcattcttttgttctttcagcagattttcgtaaacactttctaacgtgttttcttctgcctttgggttgttctatagcttgtgctttatgacaataaggacatctaacaataccagaaagcctgtgggtattcatatttaaacgtcttccagccactttatatgttctaagtttttctattctattcaggattagggcatgttcttcatcggttttcatggtttcatgatgaccttttgcaattaatacttcatctagatttttattttgaacaatactgttgttgcttttgcttttcttgtatttaccaaaccatacataacccctatgaaaatcgttggacagaatttctgaaacaacttctccgtaccaaatggaacggccggatggggaagggactttcagttcgtttaacatctcagcaattactgtgcaagaatattcctcttctaagaaccatttaatcatcattctatatatttttttcttttcctcaacaactactgcagctttgagattcttgtcccacttataaccgtatggaacagaccctgaatgcagtctgccttctcttgtggcatttttctttccgttaatcgttcttcgttttattgctctatattcacttcgagcaattattgattcaaactcagaaagcatttcgtcgccttcaattgataaatcataggttttttttggtgtaataaacaatgttccactctgcttaaatgcttcaagtatacgtcctgaatcaatttgtgaccccctagagagcctgtccattgctacagcacaaactgcatcaaactcaccattttcgattcttggcaataataatgagaacattggtcgctcatcaatagtctcacctgaaacaacttcttcaaaccactgaacatttttaaagttctctctttttatgagatattctagctcatttctatgtttggcgagtgtatcttctgaatctctgtcttctctggattttcttgaataaactgctattcttgaattttcgtgtaacgccaagtatttcatcctttcttcttattgtaagtgtagttagattatatcatgtgcattggaatttctttataaaatcctcattttaacgaaacattttagatcagcttgcttattaatctaatttaaagtatcctaattgatgtatcataggggtttaacagccactatagaccacagagtccctcacagagctctgtggtttttatttagatagaatatacccaaataaaaaaagaagcctcagagggcttccgatggattaattcttctcacatgcaaagttgtcattatcgcgatccatcttagatgtataagcagggtgagtgcttggtacgccatgcgggtatttctttctcagctctgtgcagtttgcaaagtgttctgttcctccagcagaaggggaggcttgtgcagagttagaagagctgcttgatgctgaactgcttgaatttgaattgctagggttcgatttatgtgtctcggattggtgtgttgtaactgacttttgaaccggcttagatacacttactgatttcttcggtttcgttgcgcagccattaaatcctttatcagtcgcatatccattcttactccaaatcttcaagtctttatctttcgcagcttgctcatctttcttatacgtgtctaaatacttcgtgtttggctcatatacataagctactcgtgctaatccttctttaagcagtgtttcttgtactgatttgccatctgcgtaaacgtaagccaacattctgccatacttatctgtgcgatctcctttatcaaactccagttgaagcttgccctcgttaactagctgtttatttcttgctgaagcatcctcaccatatggttgtacgcaagagtttggtttcttagtttcaggagtgtcaacaagcaaataacgaactgttttgacttcgcctttatagttaactttaatcgtgtctccatcaaccgttctgttaagtgttacatcgactagctttttcttattgtcagatgtctttttatccgacgaatccttctttgaagcattttcggctttttcattcttgtcattattgcttttgtcgtttgattgagagtctgtctttgtctcttttgtatccttttcttcttgttgcgttgttttagccttatctgaatctgttttatctgtagaagcagaatcagacccacatgcagccaaagaaaagcttagagataatgcgccaatacctaacaaccatttcttcaatgtaattcccccaaatttgtttgttctgtctctatatcggacaaaccttcctaattataaatataaaaccaaagattgtaaatttgattttgtcattttaaaacactcaaataaagttgtgtggtaaaatttagtggtctaaaccttagaggagggaaagttatatggaagaagggaagttaattcaaatgactcttaatggaataaaggaagctgtttctaaatacggaacattccctatgtttcatcatggagggtatgtcatggaagatgctacttttcatttcaaagatcctgctagtcctcaagaaattagcgatatagaacagaagctaggtgttaccttccctaatgactataaagagtttttgttacagcacaatgggatggaaatgtttgatgggattgaaatacttagcttagagggaatcattgaatataatgaggttcaagatttcccagagggatacgttttaattggatatcattttgatggaagatatgtcatagacacaaacaaatcaaaaaatggattaggttatatgctatatctagactcaattgatgatattgaagatgcgattaacttagattcgaattttgaaatatggtttgatatgttagtttcttccaatggaacgaaatattgggaagtgaatccgaatatccgagagtattataaactggtttcagaataaaaagactccgcataggagtcttcatctacgttcatctacaattttacttcttttttgtataagaagcccaccatggatttacttctttcctgtgaaaattcacatcgataggaattaaattgcttgtctgatttcctccaccgtactctctaggtagttgatgatgaatctcaaatttcacccaagtttttttgccgtattttttatcataccatttcctatatgctttgcgttctgtagttccccattttactcttttatcgctaggcacccatttaataaatgcattaggtggagctaatatatttaatcctgattgcttatctgtgtaattggaggggaaaaacattcccttcatattcgttaggtataatccttcagtccaggatatcgttctaacagttggttttttccctgcccaagtagcaattgcgccgccagtatacttccaaaatgttgttttgtttacattaataaattgatgaacttccgatccctttttcacttgaggccctacaaaggtctttctaatagtatgggggcaagtaaactgtttattataataaccacttttgcataaaccctggtgtacttctgctgacgcaggaggaatccctactatttttgaaatttcaactccgtgcatcactttattaacttttccacctaaaaaagtgtgactgaaatagataatactttttgcttttttctcaacagttttccgttggttttcagaggtgacttgtccagatgatgtctgattaccatctttgtcataagctatataagtctgatatgaactttcaacatccattccttgttccttagcaattttttgcaacttactttctgatccagctaattctcttttagaggaatcggtgttttgcggtttttcgtttactgttgagatacgtttgtttaggtcaatgccagttgcattattatcagtgatttctttgtttgccgttgcctttacatcatggaggggatagcaagagaataataaagagagagctattacaactaaccaaatgctttttgacacatacttcataatggtttacactcctttttcttctgtttaaacctgctatgagtatctaagatgtaaataaataatatattttacaattaatacctccttccgcgaggatagtatcaccttttccattttttatcaactgaattaagcctattttaagattttgttaaagttcaaatctcctaagaaagagaccttcgacaaaaggaagaagctctccttacatgtaattttatgtggtaaaatttagataagattgagtgggaaggagacagatatgaaggtatttgaagcatcctcgttaatctcagcagcggaaaagcgagcaaaagaatacgatcagattagagaacaatttatcaatctcagaaaagcatttcaaggaatggctgatttagatgacagcgagttttcaggtaaaggtgctgataacattaaagcattcttccaagatcacgctggtgttacagacagctggcttgatctgatcgatatgaagattgcttttcttaacagtatttcaggaaaagtagctgatgccggattagccgattcgtttgtggaagagtcatttttagagcatgagttgattcatgcgaagaataagtcaaaagccatcatgcaagagcaacggaatgaaatgagggatattcttaatgagataagtgatattgttcatcttgatgttttctctacagaggatgtcgatcaaaagctggattcagcagataagaaacgggacaataccatacacaagctcggaaagctcgatcatgatctaacgaaggaatatgcagaaaccgaagcgaacgagcatttcatccaagccgactttcaacagcttcaaaatgccacgggtaaagggaaaaacgcaacaccacttcactataacgccaaggcgtacagagaaagtgacatacataagaaaaaaggcgagattgcaagacattcggatgcttatttgacgattaaaaaggaagaagcgaaagagcgggaaatcaaggatctgaagaaaaagctcgctgacggtgtgaccgatccggatgaatatttagaaatcgcgaagaagatcggctatgaaaaccttgaaccttcccaacaacaatatgtgatgcagcttgaacaagcaaaacagatggaagaagccggagaagtgacttgggatattttaaaaggagccggcgttggtttatatgatgtcgggaaagacacggtaacaggtttatggcagctgatcagcaagcctgatgaagttgttgaaggtatcataggggcagttgctcatccgattaacacgtataattccatttcaacagctattgaggaatcgtatcaaaaagatatggtaaatggagatgcttactccagatcaagatgggtgacatatgcgataggtacggtagttacctctgtagtaggcacaaagggagccggttctcttacaaaagctgacgtagcaggaaaagtcacctctaaagtcagtaaagcaggccaaaaactgaaagatgtctcaattgctgatttattgccttataatccacgttacgatgttgttccggctggaggagttccttataatgtagttaacggtgagaatttaaaggatcgtctgcttcagttaataaagtccgccaatcctagaacaaggttgcctagaaatcatgggagatgggaagggactcctggtaacggtaaatggcactcagatagacctgacgttaatgcagttactaaaggagaacccgtcacttttatagatggcagaccggtttttacaccatggagcaaagggacgattaagtttaaatcaggagaactgaaaggtactaaaaaggattttccagcagtttataaacgtattcaaaaaatgaaaggctttaaaacccaaaaagaagctgaaaaatggctgaaagaagtagttagattaacaccgcatcatttagacaataacaccatccaattaatccctatggatttacatggtaatatacctcacgtaggttcggcatctgatttaagaggaggattttaatgggtatacaggcaatcaagaaaaaaatgagtgaattttatttagatataagacttgataagaacataaattctcatcaagtccttaaaaagtttgaggacgaaaattctttcgacataacagatgaatataaagagtttctcaatttatacggggaatgctggatagaggaagataatgtgtttttccctgttttagaggacaatccactagcagataacggtaatctccggttgggatatttctacggtcttaataacaatgatgctaatattatcaaattaaaagaggatctttcagaacaaatgccggactggattataccgattgctgatggtgacggaggagatcaaatttgtcttggtgtgaaaggagaagcaacaggaaaagtttatttttgggatcatgaattgacaaatggaataaaagacacatttttggtcgcaaattctttctctgacttcattcaaagtctgtttattgaagagacaacagatgaagacgatggtattttatctattgagctagatgatgatttattaaacagttaagcaaaagtattgcaattgcatgatgtagcagcataagtgtccttaggcaaagtgaaagtggtttaatccataaagcaatagtattgcaaataccatttttatgtggttataattagtgtagatgatacagttatataattattttttgcatttgatttgtggaaatgcataaaataaaaagaccagggtgttggtagcaccccggctctgtacaaaaagctgcccatcaaagggcttgctcagcagttgttcatgataggcctaacccttcaggtttccaggctcaagggaggtctattttttatttatatacgtcaacagggcgattataaacgacccgaatgcaagcattaacattaatgcctgaaatgttgacataagcatcaccccctttcgtaggggatgagcaagactcccttgagtgagcatgctttaatgtacaggaatcattatacactaattccaaatatatgtctgtgattattggagccttattgacaatagacaagttataatgtagtacttttctttttgaaatttgtgttataagatatattaagattttcaacaagagaggaaatttatcatgaagaaagaaattttgctaattcataatggctcaagcattacatatgcagacccacatgaagctgctaggagttatgctaaagctgtcattgatggggtaaatcctaatgaaatagaactatatactgacattgccgtaaatcttaaagaccaagctaaactgatgaaacaatttaaccaggaactatctaagattgtaaatacaagaattcctatgatggaagaaaacacaaaagagctaagcaatgaaatggaaaattcacatcaaatttataagggaatttcaaaagaaagcataaaaagaaaaaggattagaaaaacgaaaataagcaggctataaaaatagcccgtcatttgcgtgatcagaaagaaaagcaatactttgtgccggagtttttaagtgtgaaaataaattactatgtcccccttacaagcatacattgtgatatgtaaggggggatttttcttgcctagataccggagcgctcttcgcaagagagggcctttgccttttcggtatgtgttgcttctgtcgtttgctttttttatcatatcgacggtcatcagcctctggatgatcaactcctcaatcaaaccggtgctgatgaacataggagaaatggaaaccaaacgggtggcgacagaggtcattacggaatccattgaagaatacatgtctcacagcgacaatgtgaaagatatggtcgatatgaaaacggatgaaaacggaaaagtcacaacgatggattttaatacacaaatggtcaacagtatgaaggcgaaagtgacaaagcagcttcaggctcatttgaaggaagcggagtcgaacaataagcagcatgaaacggaaaaaggcgcgaaaacggccgatgaaattatgattaacatccctttagggcaggtcacgggaaacagcattctcggaaatctggggccgaaaatccccgtgcgctttaacctgatcggtgatgcgttaactgatgtgaaaacaaaaataaagccgtacggcattaacaatgccctgatcgatatcagtatttttgtggaaattaaagtgaaggtcattattccgtttgccagtaaaacatcagtcgtgacaaataatattccggtctccattaaagcgattcaaggagaggtgccgcagttttataacggaagcggcggatcaggtgtgacgccttccatccagctgccgaatgaaaaaaaggagaaagacaaataaagacacacagccgcattttcttctggcggctgtttttactttttcctgcggatttcttgaaactgaactcaagtatcgactagagcagcccataaagcttagtggatacttgctgaatagtcatttccaacaattacatcgaactattgttcttatttatattgaataaagaacatttgttctgttaatattagatcaataaaggagtgattcaaaatgcttagagatcgaggggcgatcaaatggacttccatgatgcttccagaacatttaacgcaattaaaacaggacttgttagatgtttcgaaaatggagaagccatctttagatgagcaacaaattgaggagattgacatcctggtttctgaagcaatggcgttgaataaagaactaaagtttaagctctttaaagaaggggttgctgaggatttaatcggtacagttcaatatctcaattacgaacaacacaaattacacgtaaaagatcatcatgatcaaaccgtatacatcaccatgaatgacatcataggagttgcttacaatgattgattactcacagtttccacgtaaaaatatactttgtgtagatatgaaatccttttatgcttcggtttcagctgtaacaatgggattgaatccaatgacatgttatctcgctgtagtcggaaacacggatagacagggaagtgttgtcttagcagcgtctcctgcacttaaaaaagattatggaatcaagactggctcccggttatttgagattccagatgatccaaaaattcatatagtaaacccgcaaatgaaacttttcatcagagtttcaactgaaatcactaaattgttttacaggttcgttcctgaaacatgtgtgcacacgtactcaattgatgaatcttttttagatgcaggaaaagaaaatcctgaagtcatggcagaagcaattcagagcagtatgaagagagagtttggcttagtttgtactgttggtattggtgacaatatgttgctgagtaagttagctcttgatttagagagtaagaaaacaaagactgggattgcacggtggagatatgaagatgttccaaataagctttggtgtgttcatccgttatctgaaatgtggggaataggagggaggatggagaggaatttaaaccggatggggatttcaactgttggtcaattagctaaatatccattagagctacttgaaaaacgattcggcattatgggcaatcagctttattatcatgcacatggaattgacctttctgaaattggagctcctttgatgcaagggcaaataagctacgggaaaagtcagatattacttagagactatacgaagaaagaggatatcaaggcggttctcttggagatttgtgaagaggttgcacgaagagcacgaacacataacaaagtagggcgcacaattagcttgggtattggttacagtaaagatgagttcagcggcggctttcacagagctaaaacgattgatttgcctacaaatatcacaatggatatttatcgatattgcttgatgttgtttgataaattctatacaggcaaaacggtacgaagtgtttcagttaccttatccaatattgaggatgatgtaaatcaacaattaagtctgtttgaaaaagataatgagaagagaagaaagcttggattcgttatggacgggataagaaacaaatacggatctaaagcgatcttacgagctgtttcttatacacctggaggcacagctttgcatagagcaggtttgacgggtggacataaatcatgagaacagagagcagctccctctgttctccttacaaagtcattagttttttacgtttcggctctttcagcaaccttgaacgtatcattttgttgttggagataggaagcacccactgttccggcaacgccgaataatagaactgcacagataaatagtttagttttcatattgcttctccccttttgatttgtcttcttgcttcatttgccaaacgataaaattcaactgcaccccaagcatcctgttttccagtgagaaaatctgctacagagacaccatagctttccatgtcagggtatatacttctttctttgaagaactcgaatgttttcctaactaagtctaaatcatagtccaagaaaagtcctttaaccatttttaacttttcaagtaccatttcattgttatgccgttcagccaactgtttggcctgttcataaaatttttttgcgttttcaatgtcattttgccttccctttaagaaggagataacaaataatgttttagcagcgtaatcatgattttccggctcaatgatttgaagtgacttattaaagtgaaaaaatgctttatcaagttcttccatttgattataacataatccaatattaaacagtgctgaacgcatcaaatgcccacgattcttttcacttttgtttagctctactgcttcctgatacgctttgtatgcttgctttaaagcttcatcaaacttcatactgtccaataaattaccaaatatgacgaattgacagcgtaccttttgtaccccgtatgtagggctcccgtcaatagcaggttgctttttaaatatatcgtaagccctcatggcataattcattgaaaaataagtctgtttcatgtggtaatacacttctgacaatttaaaataaaattcagctttttcaacttcaatatcttcgctctcaattgaatccaaatatctctcagcttgtctatagtgattaagggagaatgccaactccttttgtctaaaatagaacatgcccatgaaaaaataatagtaatattcgagcattccagttaagttttcatggccttcgtatgcttttaactcaccatagtttttctcaatgtcttttatagcgttaggatacatatatgccaacattagcttatgtctaaactcaagtagggagtagtatagtaaaacatcttggttttcttccataatttttatttcctgcataacttctttacgcatttcttctgctctaccgacccaattctttttaatagccacataccaatgattcatctttgttgctactaaatcataaggaatgaccttttcgttctccaagtcctaaacccctttcaaatccattttattatatagttgcattggaggaaagaaatgtaaagggaatttgagtgaaaattaaaaacaaatcaataattcgattatgaacgaaacgaaaaaaataccctcctcgttagagaagggtatatgatcagtttgctgttgcttttagagaagcaagccactcatctaatgttccagtgaagccttgttgaacggctaattcatatgctgattttccatctttaccggcagcaccagtagctcctttagcaccggttgcaccagtatcacctttgtctcccttagcgccagtagctccagtgttgcctttttcaccttttagtgaagctaaccattcctctacagttcctgaaaaaccattgtccactgcgatttcataagcagacttcccagtgacaattgagacattaaccattggattgaaaaaactcatttatgcgcccccaaaaagttatatgtaattcctgactcagaaattttgaagcttgtgataggtgaatcgtgagcgtccatttgaaagccttgtccagcccttaaatagataggatctccaccattgattgatacgtggcatttctgatcattcgaaaagctgaacttatagaaagaatatttaatcgtccaggttgcaggtggggaggggattacttcatggttagattctgacttctcaagcattggacttccgatatatccagatcctatttgcataatcaacaatcattcctttcttcttgaaaatgaaaaaaagggggagataaactccccaagttattttggctctgtgtattccatggcttgatcgctgtctgagatacctgtagtggttggatccactacaaccccattgcagttagaaatgtaagcaaagcattaaatttctcagtaagatcatcgctaaacacagaaatgtcgtatccaaatgcagatgcaattgcttgtgcaaacaaaagagttgcagagaagattgcaaccaggaatgttttctttttaagtcttactttccagttaattttagtcattaaatcgtctccttataaattagctaatttggtgatatcaacaccagcgatctctgcaccaagcagtaagagaataattagaactaaaatctttaatgtcttgccgaatgttccttctaataagttttgaagccattttgtttgcgactgattaacttgctgaaactcatttcttagtccagctatctcagtggtgaacaaattttttgtttcaacaaggtttttttcctgattctcaacaacagtggtaagcctaatgagcgattcacttgttgttttttgtgtttccaacatgatttttctatcttctgcttgttctttaagacgttcttttatatgagcgacctcggtctttaaaacttcatagttttctttttcagccacaatgcaatcatcctccataaaaaataggaggtaatgtcacatcacctcctaaataatcattgatacactttgagctacaatcattctcaaagatatttaaatatatttagatttttgagccaaattgtcctgagatgtagcctcgtttacctttgtagataacttcccagtaacccttagcattgtttaaccctttcactgagccagaaatgctgacggtatcacctagctccacagtgccgagattcttcgctttgtttttatcaggtctgtccattacgatagcagcgctttttactccgacaactttaatcttgcctacagatttgattccactgctatcaggcttagaagtgggtttaggctttggggttgattttccaagctcagcatcacttttaatgtatttcacatttacatatccgctgtatgtagcgcctttggagtttgtatatttgatataaccccaaccattttgagttgatcctttttggtattggacagtggagcctttaggaagggcaagtacaatagaggagttcgcattgcgctgagttctcacattaagactgtctgcgataactgtgttcttaacataagagccatttgttttaacgacttttgttggctttgaagatgaggaagaagttttcccgccgagtgctttcaattcagcagcaatagaagctttaacagcattccaacgtccttcatcaagaactcgatgtgggcaatacttgccagaccagtcttgatgctttttaactcgatctatgccccagccacgttctttaaggagttgtgcaataaacttaatagccaacgcttcagcttttttatagcgctctccgcctgatttagagtagcaaacttctacaccgatggaagtccggtttcctgaattcacacctgatccatcacccgtatgccatgcattacgatttgtaggaatcccttggacaacctctttatcatctacagcaaagtgaaaagaaacttcattattgttaccgatcatataactaacttcattttgcgctggtgcgtcgttgtatgtattgtgaaaagtgatgaatgaagcagataatgcatatggacatttgattgaatatttgtctggtgatactaacatttgtctcgcttgaatagccatattaaacatctctcctaaattaaatttgagcacaaaaaagagagaaggggacaaatccctatctctctttatctcacgtatgctcttgttatctctgtttttgaatgccgtaaattgaataaaatttatattttaactagaacataaccacctcctttaattttaagggttacttaattaagcagatggcaatgccgtaaccgagcttgtctgaatatggagttacaatctccatagccttccaagagtaaaacctgtcttctgattttgtgccgattccataattaccttcaattcgatctcccacagaaacagtactgtccactttcacataaacctgtccaagcaatcctactatattccattcaggacgttcttcacgagggacgtaatctattttttcaatccactcagggtttactttaggcagcttcttaacatcaccggtttctgggttgaccacatcttcatatatgtatccaccaaactcattctttaaatatctaccttgccagtgaatatcagctcctcctagaatagttcctgcagtttcagagattactccgtgtacatcttcaccttttctcgccgggcgaattttagctccttcaagagtgacaattgtccctgtcggaattgcttttccgtcaagactttcaaaatactcagcgtaatcactaaaggtggctccgccattcatctttcctgccgatgttatatccccattcatggagtttagcatccatttaatatttgctctggacggagtagcgccatatccgccaaccaccatatagcgatcattttcaccaagttttacacctccagaagcgtggatttcacgtgatacattttgcccctcgatatgagaatcattggagttgtaaacaccgctacgagatccatctacagagcttccgcctgatgagccgaaaacgttggttcttgttccctttgcaacgcatcctccggtagtagctccaactaaagtggcatctccaagtgcttgaggttcacccgatgaagctaatactgcactagtatttgttttagcatagccagaagtcgtagccccacgtagaccgcccttgaaattattcgggataaacgtgtaggtttttccggcaattttactgggagtagcgtattgttcacacatcgcagcgctaatattagcttgtgaattcgtgcagtaaacacctatcgaacctgctttgtttgatcccgtcatgttaacgttattgatattgactgagccaactttacttcccacagcaataccaactaaagcagattggttaatggttacattcgagatgtttacattatctgatttttgagctccaccgattacatagatatcgttactcgctgttgtaaatcccgaaacagtgatgttgcttaggttgatatttttgcttttatattgggtggtgatgattgcagtgtttttataatcataggttggatcaccaattgcgttgaagttcgaaacgttgacatttctataagcggaaatgactagtgcgcgaggatttaaaccttgataaaggtcactgaaaataggatgttgtgcagtgcagttaacgacattaatgtcaaatgcacttgtggagattttttcggaggctaggtggaagccaatatgtctaaagtcgaaagcgcggatatcattttcggaatagcagtttattaagtttacgtttcttgctgcaggtgctctattgtgagctttgacttcaaaacccctgcaattttttcggctgtaacagttcacaagccatacgtttttagagccatcatcaatttcaaaaccgtttgaatttgaagctcctttgctgtgtgcggatccattagcgtcataggcgtaacagttagtgaagaagatgtagtctgaatagtgagttgtgaagccatcatcaccatagttagttgcagtacaattttcaatccaaacatatttgctaccatttggctgataatgatctgctccatcagaagaagagttccaaacaggggagcttacatcaaaaccgtgtacacctggattacgagcattgacgtttctaacccgaacaaatttagagttaacaatccccacacagtttgcatttgttccatttgtaatggtgttgtcctttttgtctaaattccaatcgaggtctaagtcttcaattaagatatattcgtttccgtttgtgtagtcgctattggttaacacacaagatgttccggtagcagttgggtgaagcttgataatagatcctgatccaacaccgtaaagtctgacataagaagggatatgtaatccttgaaccatataaatacctgcgggtacaaaaacttctcgcttcccgctggcaaaggcagctttgaaagcttcagtgtcatcagtaacaccatcacccttagctccaaaatcctgaacattgacacttcgtctgataaactcatttaagactttatcaacaattgttgcaccagctgcagggatttttgaaatgtctccaatagtgtttgtgatatctgttaaaccagaatcgactgtgcttattacgtttttaatatccttagaagctttatcaaaagcctcttgaatatcgtctgcagtatatctaatattatttgattttaaccctatggcatcaatgggtatccattgctctgtttcttcgtccttatagcccattgtgtttacgggaattaaattgtcgctcaatatatactcctccttatccttttctaatccaaaccatgcttccgtcagggggttctacagatggttttatcctcatctttttgggagcattgttcgttctcaaccatactgatctgatgttgtaaggctctacatagctagaaacaatgttgaaaccatcatacttatctgacacgctaatatttatccagtcgaaaccatcccatcgatattcaatgcctgtttcttttacagtgacagtccaaccaatttgaggggaaggataagtgttcaataaatcctgataggtgtacacaaacggcaagtaaatcttcctagtattctcaactacatactcataatctgatgttgcttgtctgcaccaatttgttatttcaatacagcgcttggtgacacgttcacattcagcaatacgttcattgatacgaataatggcatcttcagcatcatcaattaagccttgaagcgtttcaatgaccatatttccttgtcgtttaatccaaattcttgaggcagggaagaaggatgcgccttctccttgatatgcaaaagtaagtgatttgccttcatttgaaccattgaaaaagacaactcccataaggtaatcaaccttaaagtagttgtcttctaattcaccatcttcaatttctcgccattctttactgtcaccactaacctcgactctgtactcacggttaggtacttctgtaagtaagactcgaccattgtaaacagttaaagtttcactatagcttaaataagggtcatcgattgaacccttccttttttgagaaagggtagggtcgttatagagctgaggaaaatccaaactaaattcaccgtcctttcttattgtgtaattgatttgagcaattcttctaagtgcgcgactctctcttctaaactctgcagtctgcccttagtaccacctaatgtttgtcctctaataatggattcagctttcttgtcaattacgttgtaaacagacttctcatctgaaattgcatatacagaatatccttgccaccaatcttgagcttgaaaaactctaacccatgcttcaaaccaattcgcctgaattgattcattgtattcccctaggtcaccgaatgcgttatggggctgttcaggagagttactgtaaggtgggatgccaagttcaccaaagaagatcggcttattccatttatcataaaatgctttgatttccttgaatatattttgtccgcgtccgtataacggtacgctataaatagcatcaattagctgatcgacagatggatttcgattatcagttaattcaaagtaagccgctattgcaataatatcgactagtccgaatagaggattattcagctttttgttgtaggcagcaatcgtttcgggagcccaatcagcggttacccaataatttgttcggtagagcatctttccactgaataaactcctaacgcttgtaataactgatttccacttttctgttgagtcttccatatgaactaggtttgaagcaatgtataaaccgtctaatttaaattgttcgcattttttagcgaagtcttgcaggatgttgttccatgctacgaaccattggtctagatcagaaggtgcccaatcggtttcagctatcgttccatttgcgatgaaggggtagggttctaaaataatgttgtacccgtcatttttgagtttagggatcatatcccacgcttcgttataagtgtaatccacaacagttggatttgagtctgaagcatccacagcattaataaggataggaatagtgattgtatttaagtttaaaacagttgagtcataactaacatcagcataatatttacgaccaaatgcagaaacatttccgcctttccatttcaggggattgaccaaaaggttattgagctcaatgttttggacacgactatcatagtcggagagtttagtgtcaacttgtgctgctgtggtttcaactaactcagcagttttctggtcactggaaacccatttttcgccgtcataagaggaaacaacaccggtaaccgtattagtccataaatcgtttgcttctggctcttcgggttcagttgaggagacagtgtatttcgagccattaagcttacctttgacttctacagtagaagaggggaggtaggggttttctgaggggaatttaggctgtacaatatcagatagtattcgaccactgctatcaatggacgtctctactgtgcgataggcttggactccaaatgtatagtgtttatttgaaacttgaccggttaatgttgcaattcgtttatcataactaactgataaatattgttcagctgacatctttgcaccaaaaagataggtatcatctgatgtgtcagagtagcaatggataagaaaaccatcgatattgtatttatcctcatcggagtctggaaaatcccattcaattgatacatctacagatccattatcatttacaacatgagttatagcagtcccgtcatttcggatagttgggtttgctacgggtgcagatatacgatcatttcgtgcattgtaattggtcagtagggtatcataatcaatctttttcttattgaattcagttgatgctttcttagcagtatacaatgagcgtgcaaagtcttgttctatcgtagtagctctttttccattcgagagtgttacttgtatactttgctgctcaaaatcaaaattcattcctgtaagtgttgctttgacatcagttctaaaatcgtcattaactaatctgattatatctcccaggtaaattctatcccaaaaatccttttctttgttgacagtgaataagttgacaatgtttgttctgatgtctaccggaggtgtatttttctccccaagttcctcaaggcctttttcatacagctctgtttcatcaaaaatgttgtcattagaccaatcatcttgacggataaaataagacaactttttcattagcttttcaccgagaaacttatccatagataaccgatcttttaacactgctatttcttcagttatcttggaaatctgattggcagtggtggatatttcagctttctttgatgtaacttcaagttgtttggcatctctttgcttgataaggtctttcgtgtcatctccagctttttttgctactgtgatcttatctaagatttgttgtaattcaattttttctagggtgaagagggtattctcctgtgttgtttttgttgcttccagatcttttttctgatttaaaaggaggtaaaaagaagagccttctttatttacaagttcattgtaatctaaaattgcatggcacaaatcatcatccatgtaatcactatgcttaattacatttctcttttcatcacgttcaaaagggtagaggaaataagagaaatcatccaagtaactttgtccagtaggattgactgaattaataacaattccatctttaccggtaatgtctaatcgtgttacaacttcatcaatatcaatggtatcttccatatcaatcatgaaccttttaggagagaattggacacctttatacttggacacagtttcttttttataaaatgatactgtgttgttcacagtatcaaatataggcacagcctcaaaagtttctccaatgttctttaaaaactcatatcgggtagaggtaacatcaaatgagcggcgtttttcattaaaagaggggtcaataaagtctacagtaaagcaagttcctttaagacaatctgtggcaacttccaacagatttttagagatgccttcatatgatttgattttgcttttatgaagaatgtagggaagtccttgagctctaacttgtattgtttgttcctcattttctgactttgtcaatccggttattacaaaccattcaactctgtttaagaactctgccttaatgagataccagccttttatgagttctgccacatggtttggcttcatcttgaaattatatcttgctttaagtgggatattaaaagttagatcgtggagttcatcaaaattcaaatttagagaggcgttagagaaatctactatattagcgattttctttttatttggttttgctaaagaaaccttgagatggcctggtttaaaatcgtaaatcaataaaacatccccttacaaatacttatatctgtatataaaccggatacaacattcgcccgttattttaactctgtttatcccccttgttaaaaaaacatactgttcattgacttgatcataacactcatacccagtaacactggaggtgatcagctctttattggcatctacattaataacttcttgatgtttaattgatgtgaattttagaggttctttataagctgtcaagttttcgactgtgatgtctccatcaccgatttttttgaattcaagagagagtgggatatctaaatcccctatatttttaatttctatattattagaacctgatgatatgtcataccaatgggtagttgtttctcgtccatacctataaggaaatactttcattgtcagcttcacatatccgtcattagagcagttgtgtaccaaatctgttgcattcactggcaaagcaaaataaatgatatctaaattactactgaatgaaagaggcttataatcatctacatttagccaacgtgcaactcttcgaatattttcttcatctaaatgatcttctatgtaaaagtttaaagggatttcatatggttcacgtttaacactgtctacatacggttcagaagctgatcgtgtatatgtttcatttactgttctattcgctacgaaggtctcttccaatagtccgccctctgtgtttacattcactgccccaatttcataagaggggatatcatcgaacatgaaatattgactttctctaatcataaaattccacccttaccaatcaaaaagcaagctgaagagcctgcattatacagactcttacatgcttccatttaattttataacttctttcttgatggtttcgagcattgttctggctccagtttccccaccagtaagtttatcaacattgaaaattattggtgtgttaattgttttatcaccattagaattaacggttgtggtagggggcaggttagcagtcttaacatttggtatcaaactattagataggctcgcttggttaatattcggaattattgatggaatagaagtaatccctttgttaatcaaagctgctaattttccaccttgcccccatttaggtgtttcattattcagatcgttatcagacagattgcgaacatactttacagtttcaagcatgttcttggtgtcagtcttattcagaataagctctttatcatgaagaatagcaagcttgccagcacctaaacctgttcctgtgtatcctcctgtttcaaatgaagatatttttttgcctgttgtattgcctttggtcacagtattaagggcattagaagcttctttaagcttatcgataaggttattagagatacttttaccaatggactccatattgctgttaatgaatttagagaattcattcagttgcttagcaatatcagtaatcttcccatccattagctttttctcaagttccttaaatccacgctcatcattgacgagatcatcatatttcttgttaattgaatcttcgtctttttgaagctgatcttgcaacgcttctttacgtttgctactttcacgatctttaagaaactcatctaaatctaactgttccttttgtaactgctcagttaattccttaacctttgacttaccaaattctgagtcatcaagagaatactgattaatttggtcagtgagtttttggatactctcttgcttctcttttaactgtctttgaaatttagcttcatcgtcagttttatcgatctcatcaatcaagtcttgtgttgctttttggtgcgcttttaattcaatatcacgcatcttttcgtacatctctttatagatggagacaacttcatcagcaagggatttgtacacatctttgattgatttctttgtgttgtaaagctccagattgtaatccttctgcttgtctttccagttctcgatttcttcagtaatttgtttctgaatatccgggaaccctttagcagctttcttttgtgcttccaactgttttatatacttcttcgcttcattctgttgctgctgaataagcttaatctgttggctataatatttaaccttgtctttatcttcctcggtcatggatattttgttgctaacatctttaagcttggattcagttttcttggttgatttctctataccgttaagcgtttcatcaactttggattggatgagctgtccctgaagttctcttacttcttcttggaaattgatgagatcaatcttagcttgttttaattcctcagcaagctgtgctctttgagcggcattcagagttttgtttgttttgatttctttttcaataaaagaaaccttctgactctgaatcttttgctgttcagttaaagcttttttctgatcgtttgtatacttacggaactctttactatcgctcagataatgactagcgagggctttgtctttagcgattcttacatcaaaatcaccaatgcgcttgtcatattcatcaagatgcgactgaacgatctcatattgaagctcttgtatctgatcgtttactgaattaatgtcaccttgaagggagaggaggtcggatttagcttgcgctattgcttgttgtcgttctgcttcagcttgagacgcatctgaaatagatgtaccgacaccttttaaatacttctcagggtcaattgtctttccgttttcctcaatttgaagatgaaggtgatttccagttgaattacccgtactgccaactttaccgatggtctggccagctttaacagtttgaccggctttaacagaaggggtatcaagcatatgcatatacttagcaacttttccatcatcctgctgaatgacaacccagttaccggcagttttactataaccagcaatttggactttaccactttgcaaagacttaattgcagtaccggcttttgcggcaaagtctgtccctttatgtggagttgatcggtaagcgccatcttgagcaccatacttagaacttattctaaacgcgctgttcttcgtgtagtagcttgcaatggaggaattggcagaagtcattgacttcgtgtaatttgacatgatcttctgaacataattctgtgtttctttgaagggagggacgccgccatatttaattacattaccaggccctgcgttataagcagcaagtgctttctcaacattgccaccaaatttgcttagttgttgggctagatatttcgtgccacccataatgctctgataaggatcataaacattgtttacgcctaagcttttagcagtggaaggcatcaactgcatcaaaccagcagctccggctccagagcgagctcttgcattgaatcctgattcttgttggattacagctgcaattagagctggatcaacaccgtatttgcttgcggcagaattaatgtagctggagtatttaccggagtaagacccaccaccagaagaaaaagaaccaccagaagatgaaccagaggaaagggaagaggtaactataccgtattgtgcaatgttccctgacttaatttgatccttgaggagtttggcttgctcctgcataagctttttcttttgttgaagagctttaatttctttctgcagggcatttcgataactttgggaatactttggatagtcgtttacttgcttattgtacttttcgatttcagcattaactttctccagagcttccttgtatttatcagccacgtacatggacgttttggtttcttcatttgctttctcttgctcgtctgtccatttttcaagggaagtacctgattctattaacgcttgtttgtttgtttcctgagtagatgtagcttcttcagatgctgagatgtaggatttaagagcagctctaacgctatccattgcagagatttggctgttagaaaatccaccaggttgcaacattttttcttcaatcttatgtaattctttcttcgcatcagctacattattgattgatttaacttcgagctgagacaattctgcctcggatatatcgagcttacgctctctccgaagctttctaaggctgtcaattcgtaaagaatcagcgtttaaggttttaatggcattattgacttcagttttcattagcttattgctatattgaaccatgtcattataggcatcgagcttaacttttcgctgacgaattacttcatctcggttaacctttataacaccattttcataacttattgctttggctaattctttatctttttggattagagcattagcttcattggcagaaatgctctttccttcagccatcttttctaaaagttcgtttaaaggagcaacttgttctttggtgttattaaaaatatccccgttaagaatgccttgaacagagtcaaactgcattgactctgacatgcctttgattacatctttaatctgactgatatcatttgcgtcaagcgcttctttgagcttttgaccaaaatcttcagcttcattacctgcttcagcaagagtttcccctaaatcaccaacttccgatttaacagaagaaatggccttatctccatctttaatgttcttttgtgccttatcaaaactcaacttaaagacatcaatagaagaactggattttgaataggtctccaaaagggtttgcagatcctttttcgcgctatcaaatgctttttcatcgtttgaattcaatgccgattgcattttctcttggagtttacccaatgcagaagagaatttatcgagatcatcaggattcaaatcatcttttaaagtgagtttacctacaatgtcattgatactcgtttttaaagtattgctgatatctatagaactgtatgcttgggcgattgagagaacactgtctctaacctttgcatttccacttgctatgtcagattgtgctttaagcataccttgcttcgctttatctgcagcgattttataatcttcatcatcagcaaggaagtcccattttggtctgcctttatcattataatcagcaatttgtttgtattgcttcaactcatctttagactttttaatttctttagaagcgtcctcgaaagttttcttggcgctgtctttagtttccgtctttttaagttcaaggtattctttagtgttctcaatagcttcttctaaagctttattactttttaaaattgcatttccttgagagtcataaccttgaattaaagcggggaatgtctgagccaattgctgagtaacttgaagatattcttgctcttcatctgatgaaagggttcttgaatctttggctttttgaagctctttatactgttttattagtttgtctgtggagtctttgttggttgtaattgcttcaacattggtctgttgactctgttcaaaatcatctttagctttttttgcatctgcgaaagatgaaactatgctttctaaagcccaacccaacgcagcaagcgcgcctccaaccactgtagaaactaaaagccctctaagagcagttttcaaaacccttgatgcaacagcagcacgggtcatacctgcttctaatccgatgctagctaaggtttcttgtctcattgcttttgagcctaatataagagttgtagctaaagttcgagtgtttttactgagtaacaatgtagcagtgctaatcgtcacaaaaagagggggaggaaaccaacagtgttaattattccagtggaggcttttaacaaagaacccagagcttgagtgaactcaatcaatccgtcactaataaaggcatccgatgaagctatagccaattcagtgaaattgttttgaagtttatttaaccttgcttgtaagctatctgcgtatttctgctgttcgctccaagcgctacctgcagaattagaagctgttgcggcggcattttgggcgatagagaagttgttcattaaggcattaaatcgagacaattgatggatatttgcaacgccaatagaggtgttttgtctttgagcatcagttaatgtgttccatttggctgctacctcattaatcaactcactcgcagattttgcttctccgcctgcagtctttacagaaattccgatttcatccaacgctttgattgcgcttcggttgttacctatccgggcaaaaatagttttaagtgagttaccaacaacgtttcctgattcacgagtggtacttgcgattgctgtagtataaccaatcagatcgtttaattcaacaccgaaagtcgaagcggtgcttcctgcttttcgaatagagttggccagatcaagagtagttacagcgtagttgttatccacttcatttagcttgtctgcaattgaaatagaatcattggctgcaatattgaagtttaacattgcggcagttaaagtattaactgtgtcatcaggagttaagtcagagacgttttgtagaacctgcgcggtttttgttagagttgacaattcactttcatcgaagcccatacgcccgaaatcaccggtcatttggagaatgtcagtgattttgtttgaaagtgtgtcacctaaatcgattgactcttgaagaagttcattgtacttgtaatcaggctcattcatcacacgtctgatgtttgtcattagagtatcaatttcaacagcctgagataccatttccttgagtccagatatagcgccgtagaacaaagaaccagagattaaatatgtagacatacttttgaaagcttgcgttagctccgcaccaaaagacgaggcttgactagctgctgcttgcgcatttgaagccaattccctgtattgcatgttcaagctttgcatttgagctctgatattgcttccgccggcacttacattaaggctattaactgcattgaggtactcttggatagcttgtctatttccagcgcccatcgtatcgccataacgcgtattaaggttttgtacgtttacctgtgcttggcgttgataaagctcaatagtttttcggagttcattatttttagccacagcagcagacttatcatcgagcattttaattctgttttgtaatgcttcaatttgttgagctgtttgagcagtgtttaatttccgcccaagggaagagagggtggtgtcagttacaattccttgctgtctaagtttttctaaatctatctttagttgttcaattgcttttcgttgctgatcgtaatttgttgtaacttttgatgacgtagcatttgtctttggatcagtcgtatatgttatatcatcgaagccattgcggttcttttgagttaccctcgtcgtttgtccttgagaattcttctgttctgttcttttctgtacctgacctagtttttcagtcgcttgagcaagcctgttaacttcttgggtttgttcacgtagtgattgattacgattgtcgatgaatttcttttcacgctgaatgatttcgccatttttcttatattgctgcgtcagcttttcaacagtgccatcggcatttctggtaaccgttgtggtttctttaattgtttgattgaaggatttgagatgtttttggtaagtgtcaactgcagaggagaattcgttgagagtctttaaagcagaggcatcaatattggtctttaaattaagggaattaagctttttctctaaagatttaatttgctgatttaactgttcgacagtctttgaggaggtatcagcttttggggtcagtattatttttaaatcttgactcaaaaataagtcacatcctttcaagtggggctaatcagagcaaataaaaaagccactcaaattattgagcgactgtacttgttttcttgataattacatccatgacaccttgccaatactcagcgttttttaaagcttgctgtatgatattcccatcttttttataaccttgaggctcatatccatcatcctcgcgagaagggaggaagtggatatagtgtataggatttttgaggttttcgactgtaattttaagcgtaattgacttcaccatttctgtttgagtagaggaggctgacaaaccaccaattgttgcaccaattccgccgcctaataatcctccagcaataatccccgatttggcaaccttcgaaatcacctggtcatccagtgagatttcagattgaataatttgggcaaaagggacaacatactcgtttatttcttctccatttagctgatataccttaaggatagatttatcttcattgtaagcaattttagttttataagtgctaaagaaattatcagggttaaattcgctatcataggtctttagtgtttcagcattttttctaatcttttcagcaacagttgcattttttattctgtaaggttcgagcgctaaataagccaaaccgccaattatcagaaaaacccccaaaggtctccagccatccattaaacagaagaaaaggctgaataaaaaatagccaccataagccataatcttatagcccatccaaccaccaccagtattattttcctacattatatcatgatttccaaaagtgtagaactagcaaaggggagggtcactttcctttttcggacttaatctgctcaagtaattctttaaaatatgtagcagtaataacaatgtccctatcctttcgtacaacaaaaagtaggagaaggcaaatcgatgttgcgattagaatataccaaagcaaattaaaactaaacataattctgagagatagtaaacatgttcctatgagcacacttccaactgtccacattttcgtatgatcgaaggacgcttcaattcgactcatacgggaaatagctaaaattaaatctgatgaattgagcgattttaggatttgaaatttgcgcttttgttctgtgtagagctcaccagagtgcgggaattctttttgtatgtatttgatcaggtcgcgactattcatctgtactaaattgtgtttaagtattgtcttattcatatttttcacctctccatattatcgtcaaatatggaaataagtttaaggttttatccataagcaaaacccttcggtagaaggatcttgattctgcataaaagagggatttcatttacacttcaaattttgctttcttgtcttgaatagcatctttgtttacttctagatagtgattctttgttacgtcagtgcctttatggttcaataattgagacacgtcctctagactcatgccactgtgatacagaaggttactaccactgtgccttaaatcatgacagtgtaattcaggaatatcaattatttctccgattctctttatccaatatccttgtaaagttccggtttcagctttcttccatatgcctccgtactttgttatgaaaaggtattcgcattcaattccgttttcggatctgtactccagccattccttaacaagatcaatagctctttgagaagggaagagggtgactttatatccttctttttcaatgacatcttccacccgaagtctttcaaagtcaatttgttcaaccttaacgttgcttatggcattagctctggccatcgttgagagaccgaattcaaagaagagctctaactgaatattttccttctttttaagtccttttctgatttcttcgacttgttcttttgttaggaaggtctgtttaatttgaagtttttcaccagttccagctttaggcctgtctaagaagtcaacgggattctctttaatcttacgttttttccttaaaaataaaaagaatgagctaatactactcattcgtctctgaattcttcgttcattattgcctagaatactggtgcaaaatgcaacaaagtcttcaattaaatcaaccatatcatcaggatcttctttaataatatccacaatgtgctgattattgtaattctctaaaatgtataccagccattgattgaaatctgattgatatcccactttactggattccgaaaggttcatgtttttaaagacaaaatactttcggattaattccgcatttttggggttaattttgttgaccttttcttttgttgcatatgctatcttttttctggccattaatacaccaccgttattctgttttaataccacttgtatttaaatcttttatcatagcagcaactaatcgtccatcttttaaggattcagcagtattcttcatgactgggcgaggttttccgtaaccatagccgtatttatctggatacgtgtacccttgaccagtctcaacaaccgtagcaacatccttgccgttgtcttcacggttgttgtctaatgaaattccgttatattcgttttgaatgacaaaggagtccttcaaaagagaagtacgttcatatacaagaggatcgtatgtgtcatatacatcagattgtacatgctcttgacccgttttaatcatcgtattttttgtgctggattgtttttgaacggcttgctttgcggcaaattcaattaatgctgctatttcttttatgttcttggccattattcagcctcttgttcattctcaatctcttcgaccttattaaggatgagatcatttatttcttcaggagatatgtttgaaagtttgtctaaattctcttgcatcatctttgttgcttctccaaatttcttcatgctttcttcagggaagctactaataatcaatgggaaaaattcagagtccacaagcttaacaaaccacttaactttgtttttgatatcacttggaatacccaagtctgtaaattctttaattagtgaaaagaatccccattgaacaggatttatgcttttaaagtcaatgtttttttcttgagcattttgtgggtcagtaattaattcagtaagcattttggttaagcgggtaggggagaagtaagggtaaataaaaacatgaacgtcctcagtaagttgtactcgttctttcttgtcatatttacttacactttcttcaatcaacccaagatttaattttttcgatgccatctcatttcctccttatatatcctctgcacacattaaaaaagacacctcaataggggagaggtgtctaaataaaacttgtattttattctgtgtctgcttcttcgtagtcttcgccggtgatttctttgtactcttctaaagtgactaaaccattctttactcctaattggagctcttcttttgtcacatcgttgaattcctggtaagcttctttgacttgatcgacggttgcccattttcgactcagggcattaacccaataattgtatgtagttattttatgaacctccctttagatcagcaatatcttttaacattgtgtttattgttttgttgacttgaagcaagcttaggcggagttgggatagggtctgtcctattatttcaaaatcgttaggttcagggatacttggtttaacgctatccttgtattcttcagttgctgattcaatccatttatttttcttgggatcatatttgggcaagattattgtggggtctgggacagcagttgtactatttggaggaagagcatcgccttcaatgaagtcttctccagcgtacataaagttctcatcataataaagaacatgcataatattttcacctactaccataaaggaattcctatattaaatgaaactctggaaacactgttaatgtcattagcatacaatccatcaaaacgtaaatctccatctgttgtgaaggcaaatctcgctgttccatatgatccaattgtgggtactacaaaatccactagctgtgttggcttggttgagaatttagcaactgcagttccaatggccggcaatgttccgaaagatcctcttagccataacacattgtttacacttgagaatttgaaagggtaagtggagtattgtgtagctccattgataagtgtaactgggttccaagaacctgacgtgccactccatctggctttgtcatctaaagtaacgtgaatatcagtttttgcttcgtgggcatcggtgtaagctttcgccgagctgagtgcggtagtagctcttgcttgtgctccgtcagtcgtctcatgtgtttgccaggaagtccatgttgaatcgctctttctaaaacggaaataagtatgtgttccgtaatatgcttctaatgcgaattgtgcaatcgtagttccatagttcatgacagctaaatagacattggataagttggcaggggagtgaagcccctgatttgcgattaaataaaacccagtgttaatcaaatcattgtactccgttttttcggagctacctttgtagaatactttcccatcatcgtcagtgagtttgaaaagttgagcagcgtcccatttttctcgatcagacttgctgatatgaacattagtgtcattcagatgattatcaaagtcacttttagtagcttgttttacattgtctacattcccaagcccaacctgttcagcagtaaccttgtgtgggtttgattgatcgttagtatgttcagctaaaaaagactttgacctttcatcggagctgttccaataactgcgctcgtcctttgtgatatgtcgatccaggtctgcatcatgagcgtcaaaatcaattttcgctgcttgctgtacattatcaaccttagataagccaacttggcttttagtaactgaatggggatttttcttgtcgtcaagatgtccatcaaaagccacctttgtggcttgctcttcattaagtacatttggtaatccgacttgctctttagttacatggtgcgggttttctatgttctgagtatgcgactttaattctgaattttgcttttccatgaactcatcgaccttatcggataaacgtttttcatgatcagacatgtgagattcagttctgaaaaattgatctttaaggttattgatttgtatattgttttgtttgagctgacctacaaatttactgctgctcattaactcaccgcaattcctttaaccgtaacatctccatttacggaaatgacctcaaccatgaatttgaaaagccccgcaatatcgaaatcccagttttcatttgtattcaatgtacccgtacctaattgaaaatcagttttgtttgttccagcaatttctgtcttttcgccattttcatctacagcaaagaattttatttctcttgaagttgaggaaccagagatcttaacagtaatatcccgataatgtgatactacaaattcttcaccttcagacggggcagttgttgcttcgtggaatgtaaaggttgctttatctggaatggtttttaaaatattttcatcggtttctgtcaacaactccacctcctaaatctgtttaaaaactgacttttatttaaaaaggagaggggaagaatcccctcaaattatttagcttcaaatactcttacgtctctgtcagtaccgtcattgatcacatagacataaagtgttttaccagcggcgacaggaactgaaaaaggtttgtcaccggctgttaatgggatacctgtatcagcagttacagttgagttcccaatgtaaatcgtgccttctgcaggtgggtaaatagtaagtgctgttctgtcagtgatacctgcggtaactttttgagctgttgaagtaacagtgaatttatccgttttaaaagaggagaaaccaggatctctttcattcaaggtcacggaaggggattgtacttggatgcctttgatagcatccaaaccagcttgaggaaagtcaacttgtagtggtttttcttgtgattttagatgaatatcggtgattggtttaccagttccatcgtctctagctgaagtgtaaatgtctccgtctttgtttaaaagtgccaagatatcaagctcctaacgttattttgtttcttgcgttgttccaatgtctacactgctattcgatgtcgcatcttcttgttcagttttaattccttttgtcccatcagggttacgcttaacacgggcaaaagtaccgatcttgccattatcatcagctaatgctcggtatccaatttcaggtgtgtaggcttgtccagcctctaaggacatgtctgcttcaccagagaaattaactttaggtaactggatataaaggtcactgtaaatttttgatgtctttggatcgtactcaagtgtgtggatttcgaagtaatagttctcggagaatttttcaccactaatttcaactgtttctgcatcaacttcaatttgatagtgagctgttacagcgttccctttagcagcaaacgtttcaggaacagtaattgttttgtctgaaacattaaattcttgttgatctccgtcttcatttgtaagtgagactttggataaaggagtatacgcgattttgattgtgccggtatcacttacagtaagactttcatcttcccatacagaaatcgtctcgttttcaatttttacaccttgctgcattgccataaaatcaagatcaaagaaagcattttttacgttgcctgaaacctctttgcttgagttgatgacatacaggtctctatttccccatccgccttttaaaaagtcttgttggacttgttgggagaactgagtcatttgtgttacagaagatgcaacaaccttgtggtcactaagtcttttggttagcaccttgccaacttcatggataactgtttgttttgccaagtgttttcctcctaatttaaaatgaaaaagagactgtgaatcagtctccgaataattgctctaaatttttagcatctgctgtactgaggtggtgtttttcttctctatacatatcaacatgactattccagtcaccgattttcacatcagttgatacagtggcaaataacgcagaagtgttataattcattatttcacccattctgtaatatgacaggtacaattgataaattgtcatatcggctacctcttgatatgtgtatccattaaatgcagccacacagctagcgatgtcctttaaatcattttgagaattttggagttttaattgattattcaaatcatgaaactcctgtaattcatcattctcaacaattttctcttcagtcaggcaatgcatctctaatatcaattttctaacattgttaaatgctctctgatcaataagatgtagtgattccttgtccacaaatactttgctaaacactttaaaataagcctggttaaattcgggtaagtaatcatgaacaattttgaagagactattcttcttcaattcgataattaaatcatttaatgaaccgtcattgttgatttttgaaaagtttctgatgatttccttcttgctcattttcatcatatttagctcgcttatgtactctgggtaatctcttaagtggataaagtttattgcaccgacttcagtattaataggccttcctaaaaagaaaaaatcctttaacacattcatttacttgctccgaaagtgaatatcaatttgtatcccaagtacccttcaggcgcatttgatatgagcaaccttgtatatttaacatttttaccgatgccagcaaaattttgattgaagagcatgtcacaaatacgatcagtaattttcaggttcctgaattcggtctcctcataagtgttaatgtgtgtataaacatcaatcatcaagtcttgatctagcagcatcacactttgggttgagggtttagggattccattgccgagataaacacaaagtctgcatattggttgatcggttaaatcatcagttttgggagcacgtttaattattgagcttaatattgatggggaatcatcaactggatcataataattttccaacgtctgaacatcagggagagaagaggagagagggtcatctttataatataaaagacgattcaattctgtatcattcataatagttctaaatacagttgtcatatgttcaaccatcatactcaatcgctatcacctccaactttctttttggctataagtctaattgttccggtgtctccatagaccttggaatagtctatatcatcaacacggaattcctcaccataaaaagaaagaaaaagacccttctttaatttttcatgttttaaaaaagggatggtgacatgtgcttgcccttcaggaatgtttatagccaattctgatccaattgttgaggttgttcgttctaatacacacgggatgtcaaccttctcaccaggcactttaatctttatcggtctccctgtaacttcatcaatctttccagaatcaataagtttgtcagaagatgttagactgattgatgaattgcaaagccgcatagtagcactgtcattcattttgttatcagtggggcgcgcattaactaaccagtaactaccgtcatacaaaatcaagtctccacgatttaataagcctaaaactgtaaggactttttttgtttcgctgtcctgagtggtttgaattatcacctgttctggcttaccattcaattcaatgtcgtaagtttcaggtgaatttgctaagatttctttgaaaatttcatacttgtttgaattaaactcttcgttttcccagccactcaaataatttgaagaagaggttagataccaatctatagacatctaatcacctcaatcaaagttattcactttcagtttgctcatttttttttcaatctcatcgacaagatcttcataggatctattaacctgagctttagtattagataaacctgtcaattgaacatctcttcctacaacgttgtttaattttaaggctctgtctcgatatctgaaagagaatcctttgtacataagcattcctaaaacttgaatttgtgatgaagtaaggggatatttaaatgtattggacttttcatcataaccaagttctgtcagttcggtttcgtattcaccaactgcgttaatgaaaaactgctgttcaaggccatcagggagaatttcatttgattgaaacattgagtggaaaacgttaattattttttcataaggagtcaagatttaacctcccttatgattgagtatcaaatttaaacccagtgtattcttcaatgaacttgatcttagcgtaatcattaatcttttcttttttagctacatcaaacagctgagctttttcagactcaagtaagatttccttttgaacattttcttcgaaggctttttgggttttgtatcccaagatttgtttaattcgttctacagtaacaatttcttgtttgtcgtctttatcttcggtctcaaaacctaagtgcacacgggtttctttgtcatcaatatagattttggcatgagtaccttgaccgtcagttccagtaaatagtgaggtattgtcatagacttgggattgcacttccccagctgtgatctgtctaattccattggccggcaatctgaagtcaccgtgagagtcaatctttcggaaatataaatcccatggacataaatttttaattgtaatctttttatctaaattaaaagacatgtaatccctccaaaaataaaaggagggacacagccctcctaaattttaaattgtttaaatttgtggtaattcatattttgtgtctctgatgagaccaatttgatgttcttgtcctttggctacaccagctccaatttccatatcaaaacgagtgatctcagttccagtgataatgtcgttaccattcatcgatgtgagtccgcctttttggaaaacttgaagaggagactttttaccttgaggaatgaagaagagaagtccttcaggaagatatgttttgaagttatcgccggctttatttaattcagttagattataagcattaggtaattctacaacagaagaacctttataagtgttaagtaatcctgttcttcggatttcatccataacagactgagggagtttagtgcttgaagcatctccggttacagcctggaaccctgcaaagtcatttaactgagaaacaacagaaaagtcaccaacaatagaaggttgtccaaatcggcgaatctttgtgataatatcgtctacagatgatttggtgataccttcagtttcagcaaagtatttaacacctgttgcatttttaattgcattgaacatttcatttactacatagtacatcgctttgttcatcatatctgtttgaacttgctccatgccttctgctactttatcgaggtttccactttgaatctcacgatagttaacagcatagccagaagaaatggtttgagttccaatcgggtattcgctccaagttgtagtagcgaacggtacgtcaccacgggaagcttggaattggcttcggatggattcatgcgcgtatgatgtcatcattggttgctgatcatagccgatagttctaaatgtgcccataaaatcaaatagcttaattgctgaaataagcttaggctcaatggcataacgcacaattgtgttgatctcggctttagctacagggttgcccataagagctttggaagctagttccttcacatgggtcatagcagcattggcttttgctccaaacttggaaagatcttgacctgttgcagctgcagaaaagatttctacaataggggacttagcattcaatttagcatttgcataatggtttgagtctttttgaacattgtttaattcaactgtaaacattaataattacctccagaatataattaagcctgtactgttaggtacaaaccttttccgccaaatgtatttttctctaagacttttagagatactttaaactctgcaacgtcatctccagctttaacccatttacctgatttgtctgcagcaggaaccaatacgtcatctttaacaagcgcatcataatcaactactacgtctgagctaagttcaattggcagtccttttaagtcagctaaattaaaagcaaggacatattcaccttttagaactttgaagtcttctttattgcgaatttcaggtttatcaataatgtttccaacaacatacacatcaccttttgcagttgaagatgcacctggagggaatgcgttaccagaagaatcgttagggattacgactagaccagggactaaatcgacactagccttgcaacgtggattatttcgtacttgtttataagcaccaattgttccgaatttgaacattgagtattcctcctaaattttataaaagtgttattttatcttaataaagatcatcaatagtcactgaactttgttgcccagaatcacgaacttctgaataaatatcgaaatttgtgctattagtctcagaggcttgcttctttgagcgttcagtgatgaaggatcgagcgattgctgagttgatttcagaaataatttcgtttttaagctcgacagaaggagacttagagaacatttcaattttctcttttgcgacatccttttcttcaggagaatattcctttaaagcttggttaagctctccttgcatcttttcggctaccgccttgtttttgaattcctttagggaattaagctcttcatctgccttggctttttcatccttagctttttgcgcttctttttcttttgcatcagccttagctttttcatcctttgcagctttaacagcggcattcagttcttcagttttttgctttaagtcctcagtaagtttctcaactttttgatttaattctccaatttctttattcttattatcaagtttgttgtttaactcaaggactacttcttcttgagattttggcattaaattatcctccttttttttactgtttaattcaagcaaaatggcagcgtcgtctgcagggtcaatacctaaaatggcatcacctgtaaagtcaaatttcataggtatacgtccttgctctttccagccaccttcatattcaattgcatctgaatcttctacagctgctatctcaaccgaggtctcagggaaatcgccatcaaacatttttgattttaaccattgaacaaatttaggatagcgctggttgtataggaagccttcagctattaacactctttttggctcaccattaacatcaatagtgtcaatgtaagcattggtagtcgtaccaaccactgcgctgttttcaaagagaggggtgccgtccttgacttctgttaaaccgtgtccgaatggctcactgttttcatcatccaagaattctgcgcaaattggcattaacttgattgattcaaggttagcgtttatgtatttctccagccaggtaataccgttcttgttgaactgagtattgttttcatggatttcgagaacgacccacttgatgtatgtttgaccactggtttttttctgattgttaatttctaaaatcgtgcttttcaaatactaatcacctcctctcaagagccagaaggcgttccgttactgttatttgtcttcgatttaatcgtgttttcatttttcggatcatcgatctcaggtgcgccggctgacttatcgttattcttactcattgtgaaagaggtcgcatgaacagggaacttttcatcaaaaccttcgtctttttcatattccattagggataagtaagcatcaggattccatccagtagcggctatccaagcaataaggcttcctcgaccacttgtataaaggtctttcatgttttggactttttctttcctgttaacgtgggtaagagggaggtagtaaacctcaatataagagcgaggatctttgatgatattggcgtttatcaccttgttaaactcactttgaatttgttctaaccaggagaatatttgggaagaaaccatctcgatattggtttgttgagaagaatagttaccgtcttgaccattgagagcagatcctgcaaatcctaaatttgtagtgattcgtttaatgagctcgtcttcacctttaaccttcaagaaatctacattagtttccaacttgtctaattttgttccagaggccaaagagaagaacttaacacctttaacgcttcctttagcaactaacgctttttttatattctcatgctgctgctcctgttgcttttgagataaggctgatttgcctttttgatcaccttcagggaaagtctgataaattaaagtgctgttgagctcatctaaaatgtttcgtttagtgtcaacaaagtattcatcataaaccatatcaataaatgcggataaaccgattgggcgtccccattgatcttcaatgtcgctacttcctttaacagcaatagtcttattgttatcaagaactaaccattttcgattttggtctttcttataacccctatagccttgtctgatttcttctggccatcgtctaagcttgagcgatctcccgttacttgtgaacttatcaaaataggagacatcaaaagctaactgataagaggaatttttccttccgataattttgcaataatcgagaggaagagggaggacggaacaattaaagtcgtcaatagcatttgattcagttattgatccgatctcattgtcacttagagtggtggggaaagaatcatccactacagaatcaaaataataaaagccagtgccatatttgctgagttttcctaatgcatccctgacagcacttttgtcgccgatttttcttaaagccagattgaacttttgtttgttcgatttgaaattagctactttacttgatcccaaaataactctgtctaaagtagggagggctaccatgtagtcaataacgtttctatacacaccatttgcgttataaagcaatttagaggcatccctaatctgtttattgtagacgttgtggtctttcagccatgatttaactttgtcgtaagaaataccgttaaataaatcattaaagaacaatgaatcaagcggcgctaaatttgtattaaactcatatgatgactgtggttcagatgtagtcattattcacctcctcaatttctaattaaaaaagaatccaaatgaatactcatcatcggattcttccttttctaaaaataaagctatgtaatacagcgcataagcaattgcactgtacctatccttatcaattctttttacaacttgctcaacagtgaaagaattctgtgtctttttaattctgaggtttgctacttcgtcaataaacaattgagtttgaatacatgctgcttcaatcattacatcatcagatatgcttttttggttcttgatgtcatcataggatttaagcaacttcaattttccggactcaacataatccaggaattgagtaataatgtcttggttaataccttgggattttaggttgtaaacgatttccggcgaatttgggacatctggcttttgatcagtgtttattgtggcccagcatccaagttcttcattggtctccggatccgtaacatcctctaataaccggtcgattaaaccgccaccgactccgtttccatcgacaataacagctttaactcttgagagagaagtatcttgatttcctccatagtttttgaaaactctttttaccatgattgattgttctttaaaactcaatccgtttggtggctctataatattgaccacttgaacttgcctaatgaggttattgctgtttctgattatcttcaaaacaacgatagctgttttattgtttgattcagccgcagagcgggctacgtctaccccgattacatattcatgtagcaagaagttcttatttttatctctaggacaagaaagttcagggtgggtaattgtccgagctttgatcaatttactgatattaatcaatgcgccgtcacttgcaccaatccagtcacaaaggtaattctgacggaagcgagttacattcccttgtcgcgctttattaataacagacattttttgacgaccaaagtgaataggaatgcgccaatctgatccgaatacaaaggatcctttaagatcaccagtttccttaaccatcgtaaggattttttcgtactcatctgagtttttatatcctgatgtggagaaccggttaatctgcccatttaattcagcaggatctatttcgccagtcatggttgtacgagggatgttaaaaatcggctcgatagcatcatcgtataaatctttatcaatcaaggcagattcctctaaggagccacgtcttctacgtaaacccttagatgattgggcgtttgccaggttatcgatgatcgccccgttttgaaattcaactcgaccactgtcttttgaaaagttttcactcttgatttcatctttaatggaagggtaaaaccttaaaatttcctcgtgcttttctttccaaattttcaccgctgattcctttgtagaagcggtaatggctaacgttacattaggaaagcaaatagctgtatggtatgcaaccatgatctgggtcaatgtattatgactaactaatccattacttacaaatgagttggttaaaggcatatatagatcataaacgtagttctcagagtcttctgtttcaattactttagtgtaatagtaattagaatcataaagctctactaaatggttgaattcatcgctatctttattatcaaaacgctcattttcacttaataatagtgataatttttcgtaagtaagatcattagatcctttaagaacatgataaaatttatctcttgttttacctttaggataaattgctataatgttatcttgctgataagggatgacatctttatttggattgcgatttttgttacatattgatataagtttttcttgctttcttgaacaactaaatccaatttcccgtaaaaaaagatcaatattctttgtagaaatattgatcttataatgataagtattaaattttttatttagatatttttttctgaaagaaataataccaaagtttaaaagtaacatttgaacttgtttactcattttttctgatgcagtgcaaaattgtacgcttttatttgtcacacatccatcggtatcaaatagaccttgtattgtttttgcaacaatatttttaggtgctttaagtataattttaggtatttccttaccaaaagcatctttttcttccagtcctaactgtctgaagaattctcgaatgagcttaccaaatacgataaaattaattctatctttttgcttaactgcaatacctaatacgttgttaaaataatctatataattatttaatatatcttcgtcttcatttgtaaaaagtattgaattgtttctagtcaagcaaccatcaccaagaagataaccaataattaatgctaattgttcatcaatgtattctggaatattgaatttgtttctttctacttgccatctgccttgattgctaaatccatttaagaaatcatcaaagcttacatttagctttgtttcacttccaaatacattattgtttcttgaaataggtaataaatctccaactttaatttcactagaatttttgtatcttagttttccatcttcacacattactaatactgggtgatttaaacttgcttccaagtcatagccatcttgagttttgattttcttcgttttcttgaatccgcttgatatgccggccatagaagtttccattagaccatatctgtttttcattgagattttatgtattgtttcaacttcagactcttttttttcgtaattgaatagttcgccaatttctactaatccattttcagtaaataaaactgtgtctcctgcaacacattttgatccgccacgtggaatacagaagtagttctgagggaagcgactgagtgttctcatcataactctttggtataaatccagctcaattccgccgacttcgggtttcaacatatcgtaaaaaatgtctggataaaaacgaataaatgaggtgaactcagcccatttggagatattcttgccaatgaagtttgaattgtcatctggattcagaggggtttcaaaagctgcgtcgtaaatatctgttctgttttttgtgtgcttcttgtttttcgaggtgaagtttttataactagccattaatcttcatcacctgtgtcataaagaggttctttgtacacattctccaagtctctgaaaacattgttgcgagcactctttagtttatcaatttcttcaggcgacaatccttttgatttgaagtcttcttcaagcatttcatcataaaaatggtaaatgtctttgtaatcgactttttccttatcttcgagccttctgtaataatttataatcgcccaaatgattagatcagcgtcatcatatggttgggctgctaaacgaggaagaaggggataatgcccaattctgtttcaacggcttcaaataattgagaaagtacatcgactccaccactgatatcgctcttacttaactgagatacattaatttttgcatctgtagctgcctttgaagctaatgaaccccattctttagcttcttttacatcacctttagcagttgctaattcctcttttacacggaaacgaatatatgaaagcaagccttcagtatgaagtgtggttttttctccgtaatttcgaataagtttattgtattttctttcaaactgacggtactcatcgggggtgtaaccaataccccatttatcaatcaggtcatctggaatttcagattggctaacaccagaattgtttgtaggcgtagattcctctataagtggcttctctggttgtctttcaaaaacactgtctttataaccagtaccgttaaactgcttcaatgaattagccattgtcatataagcactaaatgtatctgtttttctcttttcagcttgttcccaatacaacggatcaaatttaacatcgatctgctgtaagactgtatatattgactcaatattgctgtaatcaatgtttttcttcaagcaagtcttgcaaatagggacttttcctgttttctcatacagactacttcgtgaattatagaaccccgactctttgtccttttctttttgacaagcagcacagatcaatttttccttttctttagcttttcttggcattggttcacctccaaaattttggttcaaaaacacgttttataaaacgcccagcaatagagagggagtcgagatttctcaaatcatcactggacgttctaaaaaagtattttatttataagttaaggcaccgttttcggacaaaacaaccttggttccttttaaggtatcagcaagagcatccagcaaaccttttccaataccgtttgcatcaattattaacttactcggtcgtttgtctataataatggcttttatttgactagcctgatgtttaaacgttccatgctccactttcttagagatgtcctcaatacgggaattatttaaatcaataattaaaaaggttgtttcttctcttctaggattaattacagcaattctttcaggattgtagcccgtgctcaatgtgtagctagttccgtttaagggtttagtagagaatttgacgtctcggttcaattgttcacttttagtgtttttctcaaatcccaggcttttatgcagacttgtcagggcgtcttttaattccctgttacacagataaccactatcattaatttcttttagcagctttacatattcccaaagaattttagtttcttctttcaatcttcctcatcctcatctttataaaattaaagttttatattaattaacaatcaaatttactagagtgctcttactttcaggggacaggttgtcccactgcactgctaatatttctataaaatcgtttgcagacataggatcattccttttacttttcatttttaaagcgaattatgtatgtagcctcaatacctgcatcatcaaaaaccataaatttttgagaaggttttgtgccaaaccgaccttgcatagcataatcatccgcaccaacaagcgctccgtttactacaacggttgtgctgccgtactctttttcataattgtgatgaatatgaccaccgaatatgtaagaagggatgtagccaagtaattgaggtaatcgtgttacacactgatcaacacgatcgtagtgtccgtgcacaaacacgacttcctgattgttgattttagcggggatgaatccgtcttgctcaggttcaatggagatgttctctatgttctttaatctggcttcaagataccaattaatgaggtattcaaagttttctttaatccctacatcatttttagaaggggagaggcgaccgtgattacctgccacgttgtagaacttaacctcttgaaactcacttgccaacatcgctaaaacctcggcaagcgtttctgatacatatttaatttgttctacagcatcttcattggcctgaactcttgtagacacatgaataagacctccgattaaatcaccgagatttgctacatgcagtgtggaaacatgattctgcttaccatactcaatcactttgttggtgagatgttctacacgttcattaaagatttctttattgaatttatttatgcggttgtcgatttccattccgaagtgccaatcactgaatagagcgagtccatgtttttcagcaatagcaggtgatgggaaggtgaagcgaaggggtctttttgactctaaagatgcaatagcttgtacgacatcatctttaatttgttcaaaccgtgcttgattggcaatgaatttccgatattctcttttttgatctcgtgctttgattgtttgtttttcggattcaatgcgaatttcttcatgtttttgttgaacttctttgttcatattctttgagataaagtaatcgtgccagcgctcaaattgtttaaagtctttacgccatttgctttcatcatagttggttccctgatccttgtttaaaagggcagcaattgtttttgtgtcaatgtgataagtgtctttgtttttgaaaagtctgatatgataatcagtaaatgattcgtctttttctcgttgtaaaacagtatctaaaatagctgtcattcagtcaccacctactcattgatttgtggaagttcgtcttcttcggtaatagaaattttcactttccgaccgtcaaatgattttaaaatagaattcagatcataacgctcgatgtctgtttttgtttcttcttcaataatcccatcaatgtaagtatagttaccttttaaatttactgtatgaactttcttagccaaattaaattcctccaatatttgttttatttacgtacaataagctccttcggaagcccgatgatccgaaacatcggtaacgtccgaaaaggggatataaggagatgaaaatatgagtcggataggcgttggggaaacgcccgaaggagattattgaaaacttgcgtaccagaagtctcgtaaggacattccggctgatcagtaaagtaaaacgcaagcacaaaaagacctccgccgtagggtgcggaagcctcgttctgattgcgtctatacaccgagatcaggacgcatcccttactcgctcgcttctctgccggacaatgccggatgtatagttggcgctgttggcttttagcaagctgcgatagcttgacacgccgccttggctattcgtttattatgcggacgaggatttgcacctcgcatggacgaatttcaacaaccgttagccaaaccgactattaagtagcccgttgtctacctcacagcatcgtccttatgttcgtctaagcgtctacctattccgccaccgcatcgttaggttttaagacactcgattctaagattacctgcgcttgattatacgcttcctcataatcgccgctcttaaactcgtctaatttttcccggaattctctatgacgttttaagtaagcgtctttgtcgaatttaatacgtatcggcattttcgtcctcccttgaaaaatatacgaaattagcgtttttttacataatattcattaactcacgtaggtacgcaaaatcgacagggaatacgctgattacgggttcatcgttcgaaatctttgtaagtcgaaaataacaaaagacgccaaataacgtcttcagaaactccttgtacatcatggtacatgagcataaaaggctggttatcgctgtgcgaaatccagctggctccttctacacctggcagatgagctatgataacaaaaatacacgctttaagggacgtgttaaaattcctattacctttacatcttatatatcaagtttttatgttgcttgccaactgctcagtagagtctgagagccaagggaaaaataatttgagaaggaagaccctaataagccttctcaatggcattttaaatgctcttgtcgggttacacgccttattgagaaacaaagcgtctcaaacgctcgccatttattttgcacagttttctctgacccgtgtaaggaggtatgtgcatgggaaaggtaagtctccatacagaacattgaaggagatgaagtgaaataaagtgaacgtgttgctaagtgaaattgaaaaggcaagaccgaaaataatccttttctgtgaaatgggagcggtgatcaatcgcccaaaaaccatctcacttattttgcgaggggatgtaattacaaaaagcctcgctaacccggaaaaatttttatgtgaccgcataataagcatcaaagcttacaagggcattatttaaagggaagggagacgcatctaccttacctaagtgcaagccgaagcaatacaccgcaattaatattcaggctatatgccacccataataagaccctgatgggattcagtcgcaatttgcaataatgcgttaagtcttaccgacatttttagcccgataatagccatttacctgtctctttttagatacagacatgcgagttaacctcgaaccctcataagtgaccattatccgactaactacaatgaccagttgtagctgtaaagtcgaatttaatgcttttgttcgtatgaaagtgagaatagcaatgtttagaaaaagcttaatccacgatggggcaataccccgctaatatccacttatccaaaaccctggcatccaagacctcaaacaaatgaatattagcggagaactgatatcccacatatcagtaaacagcttattattgacgacacccccatgccatcaataaaagaactctaattaataaacctggagatgaatacatgaaaaaagaggggaggtcgacaatttcctccataacttctaactctgccacttttaggagcataagctctatgtgacaaaggcgtgcaggaagcctttcctgtcgtcctcagtaaattttattaagctttcactgcgtcttttagagctttagcagccttgaaggcaggtgcctttgtagctggaatatcaatttcctcacccgattgcggatttctccctttacgagctgcacgttcacgaacttcaaacgttccaactcctggaatcttgattgattcaccttttgttagtgcttcaatgatgacattaaatactgcttccactttaggtgcagcttctttcttagtaactcctaatttttctgcaacttctccaacaaattctgttttgttcatgttttaattcctcctagtgattttgtttatttttgtgttaaagtataattacggtatcgtttgtgcttcttttgaaaaaatgggagacgtactcacccttatatgtggaaattagctttctttctcccttatggcgattatctcaaaaagggctttcagaccagttatatcaagggttcaaggggattttttcgttaaactttttccggtaaaatcgctgtaccccttgggggagtaaggctcaatacactttctatttcgtcatttttttcttactgtattttttttgccttaatcgatggttctttttttcaatttccaatgcacatttattacaatattttgatttatttgagattgacttaaacatctttccacaactataacaagatttaaatctttttaaattattctgcatgttttccaatattagatcgccaaagcactcccataatgttgatttaaatttgcttttctttttatataaatgcttaaccaaaacatcagcaacagattgctcgtcattatagattttcagcaatctgtctttaatgaccttataaacataaagtttttgcccaggcttaatgtcttcatcattcatgagccatttcttgttctggtctaatcgtttatattcacgaataattgcatcgtccaatttaatatccctgttcttgagcaggaagcggtaatcaaattttcctgccactgctgcgaaattaattcggtcagaagggataatggagtctaacttatttactgtgctttcattaattaactcaacactatgttcttctttatcctttgcattgataaagaagtgaggcactttattttttatgtaatctttaattttttcatcaacatgatcaggacgggtcggcatgaataaggtttttgcaaaatcaatagtaaagttattttccatgcataaccatttgatcacatccagatttatattgtcgctgttccatatcttagtgatgttgttgctgtactccccgatattgatcccataagcaagagttagtgcttcatagatgttcctgctattaatcttttgtttctgggctacagacatttcataatacaacggaacgatgttttccatattacgcttggcaatattgacgattaactcatcagaaataattaaggccttatccccgtcattatcaaactgcagcaacttagatatcggatcatgaatgcttgtgtaaacacctggggtaatgaaccacttttcatatttctcatcttttttgttccacctaacaccatgctctctgaataggtgaggggagcggaggatgtcaatatacccttcatcatataaagaacaatggacatcatttcctgaaagcagtccttttggattctggatattcagaaataatttttcgcagaaagcatatagatcagggcataagtatgtataacgagcaccatcaacaagcaattttcctgatttggcatctttaatcatgcttttctttttatttttaataatttctttcgtgtgatcatcgttaagaagttctggatatagaagtaaagcgtcctgaagagctgtccgatgtttctttttctccgtagctccaagaactcttaacatggtttctttgtcagttcccaatgtggtaatctcttttacagtctttgagctcatttgaattaattcttcaccggagatatctgtaagtgtttggagcatttgataagtgagcttcccttcaacagaaggatcttcttcgttgagttttgcccctaagcatccatattttttataattgccttgatattcttcccacgatgaataatacttccacattttaaactggcttttagtgaagataatttgaacatcatctttcactacgtcccattccttgccgtatatatcagttactttaaaagctttgttttcctcagcaaatttgcgaaaatcaaacgggactaataaaccctttacccatgggagtctgaccatgaagcttttgctactcagagtggggagaatcattccgcagccatccgtatgctcaatgggaatgttcattgtttttcgtgtgatctcgtaggtatctcgatcaatatagtcaacgagactcgacacatcagtttctaagtcgtcgacaacaatggctttatcaatatcaatctcccaagggctactggcactgttagataaggccatatagctattccatttgttaatgctgctaccaccaagggagttaatcttttcaatactcaagccgcatgtcaaagcatcctgatacttatcgtaggtgctttttttaatgaaacatgacttctttgtacgaatttgaccggcactgctcgtgaaataaacgtatttttcattgttatgtaaaaatccctgatcaataatgtccttcaatacttcaaaatggtaagtctggacaaccatgatttcctctgaaagggtgttttctttaatccctaatgttcgggtcaacactgaatcaaataaagaaatcactttattgtcccttaagctgtcagttcgaagtgttcttatgtcattatgttcttcgaatgcagaatagaggcattctttaaggtatgtaattctttgtgaaatgtatttcttatgtttattatttacattgtctaatgtcttaagataatctctgtatctataagacttcaaaatcttattatgtaatgaattttctttgtcattataaaatgctgatgtgtccacgctgtatatgtgaacttgcttagacaatccgtctttttttcttttcaatcaatcctctccttactattttatttttactttaaatgtgcttaatattcgctattaagatattgatttactaaacttcgatatgtaaagctttgcttattaatctttccgtaccatttgtaatcctgataaaggtattcttcttcgggtgttgctgtaccatcgactacttttccctcaataaaccccattaaatgactaaataaatactgctttttcatcttacacctccatactattttatttttactcttaaaatgattaaaataaagaccacttcatgtggttgtgtctttattatatattttatttttactcttgtaaacataaaaatccaaagttaattggatttaatttcgattaattcaaaaagatcgtcaactttacaatttagaatatgtgccatcaataaaagattgtatgtactagggaggacggttgcaaatccctcgctgtcatttttacaccatctagatatacttgctctttcagcttttatttgctctgctaaccagcctttttcaatacctttgctgtttagaaatgaatccaacttacttttaaccctatattccatttaaatcatccttttgctgtttgaataaattttataaaatgactggtttacatacaagcagagtatgattatttgcattaagatacaaaaatatttgcatttaaatgcaaatagacaatataataatcgtatatcaaccaagatacttcagaatcatcagatattaaggaggggtcacatggatacttattttgcttctgtcattgacaacttaactcgaaatgatctgtatattctaggcttattgagcgatgaaggggctgatttaaagtttaaatcaattaggaagaaaaccattcaagctaaaactcaactaactgatgctacttttagaaagagcattgatcgtcttgaggccttgcagtttattattatagtgaaaaacagtaaagagcatacaatttttattactcaatatggtcaagaagctttgagatatcaattaaaaagggagagggtttaatgtttggatttattggagttggtcaggccggtggaagtatagcggatgaagcaatgaagagaggatttcattctgttgcaataaattattcactttcagaccttaattcattaatcaatattcaagataagcttcatctggtagggacagaaggagtaggtaaagacagaagcgtagcagcgaaacatatgaaaaataactgggagtcctctattgagttcataaagaacacaatggaaaagccttcagtacaagttattttcgtagttttctctgcagctggtggaaccggttcaggagtagcccctatattattagaattgttaaacgaatgtcttacacataaaacaatagttgctgtaccaatccttcctgacaataatgaggtattggttaaccagatgaatacactggagttacttgatgacttatctatgccagagacctgtgtcttacctttggataatcaaatggttttgagcaaatatgaagggaagatttctgaaagcagactatacaaggagacaaacaagatgttccttgatttaatcgaagtcttactcaattacacggacagaggatcaaagatcagtacattagacaggaaggatttaaatcagctttttgacacaccaggaatcatgactattgctcaaacagacctcaatgaatttacaattgagggtaagtattttgataagctgcatgaagatatacagaagtcgtggaacaattcgatatttactcctgttgagtttacaaatgtgatgagagctggtgtcattctggatgttcatgagtttttaacggagcatatatcgtataatgagctgtttaatgtctttgataacaagatgcccctagacttatttaaaggacattatgataaagggaatagggcaataaccatccttagtggattaacctggatcaatgagcggatgaagcagttagatgatctaattgaaagtggaaacactgaagttaaagaaacaactgtctataaagcgaagaatcgccgtagagaggatttattcaagccgaggaagctggagaacaaggaatcgaaaaagacctcgtatatggaggcactgaagagactaaaacgttaattttaaagggaagctgcctattatggtggcttttttattttgatttttaatgacccccgggtgatcgttagctataaaagtgcttatcgtaaatgaagatcagaaagggttatttagttgatatagcaatgttttagggctgtcaaaggggataataggtgttttgtgatcgtaaaacgtagacaggagagaggaaaagtggttgtttatttaaaaatctgatgaaaaaggggagaataaggggtggaaaaacattgatattataggcttttacgatagcgattacgatgtgaaaataggctgaaaaatgggaaagtgaaaaaataagtttggtgtggaaatggaagtgctaggggtacatttgttcctattttttggcctttagatgttaatataccccctatatattggtatttaattccctatataagatacgttatgtagggtttttatgatttaggtgataaatttgcacagctaacacaatttcaaatgaaaaacaatatatatttttgaaaaaataattaagcggtcaacttaaaagtgaatacccattcattaaaataatcgtgtatataacgaaaggaaacaaatcgaagtgttatctatacaattcctcatctaactacacacctattttatattcatccttaatgttcatcttttcccatcctcattacattgcatccaccataaactatcctcagcttacctaatcatctctatccgtttccttcaccatacatcatatatccatcctatacacactaagcacacatcatcagaagcattctaatccacctagaatcaattttaatttaatcatagtatcattggtatccaatccacatacacgccttatacagcctataaatagccatgaataatagtgccaaaataatttaaaaaaatccattttaagagtaaaaataaaatgactttgaaagggaaatgtgctataatagagttataggaaaggaggtgtacatagtgcttgagaaagtgggtataacaattgctttccttattcctatcacggttttaatcatcaactgtttaacgatagctgagaagattcaaaacctgatgaagaataagaaaagcaaaaagcgtacacgcaagcgcctccgtagcaagagacaacgcaaacgtatacgcagataacacgctaaaggggaattaatcccctttagtcactacccatattataacatggacaagcacattgtaaacatgaaacgattctcattatggtttacgaacataacatttgttgttttattcttgttgtttctgttcatcaaagattatttcagcagcggaatacagtcgctgattacggctatcttcatagtaacgtgtatcattgtcattttgtcatggatcatttattttactttacgtaagaggttaaataaataaagtttgtggttttctggatattgatttacaaaaaaagatcaaaaagatattgatcatttaaagtgatcatgatataataaagttacaagttaagaggaaaaatacaatgtatataggaggataagaatatgattacagaagatagaatttttgaaatagaagaggaagagacaattgagggatataaagttagacgtgtgaacatgtcagaattagaaatcattgatagagaaaaaattgtatttaagggggaagaggcagaagtagctgaacaccttaactcactactcttttaaatatccattttaaaactctagccgatgcttattagaggtgagcgggataggaaacgaatccttgagggtatacagtatctttccgcgaatgtagaaagtgaccaccgatacaatgataagaaattctctggtcttgaaagacgtattcatgatcttgaagaaagaatcaacaattgaatttcatacatgagaaggagcggtaaaacatttatccgttcctttatttttaatattaaagggggaagtctacacttattatgaataaaattaaaataattgattcggttatggggagcggtaaaacatctgcagcgattaacaaaatgaattctgctggtaaagaagaaacctttatattcatcacaccttatttaaatgaagttgagcgcataaagaaaagcataaagtccaaacaatttttcgaacctaaagtaaagaagaaaggtgataaaacacaatataagtttgaatcctttcacgaactcttatcacaaaataaaaacattgtggcaactcataacctttttaaaaacgcaaacgacgagacaaaggaacttatacttgcaggcaattacacactgatattagatgaagtcatggaagtagtggaacaattacaggtaaagaaacatgatctaacaacactgtttgattccaatctgatttatattgaaaacggttttgtcaaatggaatgaagaaaaaaaagactatgaaacacgatacgatgacattcgagatatggcgttaaataacaatctaatgtatttcaaagacaatatattgatttggaactttccagccgatgtattccagttattcaaggaagtttacatacttacatatatgtttgatgctcaaatacaaaaatattactacgatctgaacaacattaagtatcaaaagtacagttcagcttacatggatggacagtatagcttcattgatcaccgtcctgattatgaaaggagctttaaaaaagagttaagaaacaaaataaaaatatatgaaggaaatctaaacacaataggacaactggagttttcactgtcttctaattggtataaaaataaatcaccttacaccatcaaaaaggtgaagaacaatgtattcaattactttaataatattgttaagtcgtcaagtgatgaagctatgtggacgacttattcagaccataagaacagaataaagggcaatgggtatacaaaggggtttgtctcatgtaatgcacgtgctacaaacgagtttaagcataagaaacacttagcatatacaataaacagatatacgaatactgttctgtataattattttaaagaaaagtacagtattacaatagaccaggacgcatttgcattgtctgagttagtgcaatgggtatggaggtcagctattagggatggagaagaaataactttgtacataccttctctaagaatgaggaagctgctcacaaactggctcgatacctgataaagaggacaaacctcttaaacttaaaaaataagccagtcatatcaacggttttagagcctaagtcttaaggagaaccagaaaaataattaaataaaaaataataaattcgtccgtaaagtgcctttacggccgtctcgtttcagcaagctgaacctcgataataggattttctttatttagaataaaaataaaatatctattgattattttaagtgatcatgttaaaattaaatcaagtcaaaggattacatacatttaagataaaaataaaatagttataaagaatggagaggttgaaaatgacagctgttttaagaattaatgaagagttaaatggaattgaactatattttgatagtaaaccagaacaagaggttttaactcatcttaaatcaaacggttttcgatactctggattcaaaaaatgttggtggagcaaacggacagaaaaatcaatgcaggtcgctaatggtgttactaaacaagaagtctcatcttctaaaacaatcacaaaaaccaaaaagaaagctaatggtgtaaatatgagtctgtgggatgcaacacaatggagtgaattagaagtaaataaggaacaagaagtaaaagaaatggcaaaggaaataagaaagcatttaagacaacgtctcccacaatgcaaattctctgttactactgggggtagctattcacatagcactattaacatcacaatcaaatcaagtccttatgaaaaaggctcagcttatttgactgcgatttatgattattgcaacagtcttttaaacaattatcgccattgctacagcccagcagatccttacactgactatgctggaagctacaatttctatggtcgtgtttcattagattgggaatacacagtgacagagcaaacagaagaaattaaagaagatatgacactgtttgattcaaagatggaagaattcgaagaagccgagaaagcgagaaaagaaaaagaatttcaggaatatttaaaagaacaagaaatcaaaaatgctgaatataagagacggcaagaagaaaagaaacaagccgaaaatatctatagcagcattgtagtaaaacaactgaatgaagatcaagagtattttgttattgatgcacagtttgccaacttaaacaaaaatcaagcacttgatcaatataaagacgaggttgctaaaggtgactacagacttgaaaatgtgaaaattacaaaagaagtgcatttcaatactgaagaagctttaaacaacttttctaacttgcttttaaatgattttgattttcttgcggaaaccggtggaagttttacggaagacaacaggatcaactcaatgattgattattacaatatggacgatttagaaaagaacacagttaaatggaatttatatggcgtaggagtgtactacggcgggaaattgcaatttattgtagacgctcaaggccattcttatgcaagatacgttggtttagtggacaatgcaaaaattgaaaagtcaatttttgataaacaagcgataaaagaaggagaattagacgagttaaaatatcaagcgggaaaaatagaagatctttctagctcagtcattgaagaattaaatatatttgcaacctggaataatgaagactgggacaaatataaagctttactcaaagaaaaattgaaattgaataatttaaatttgagtaaaaaaattatccaacaagcagatacagaggaattgaaaatttctttatacagaattctccatgaagttgacagcattcaagaacaatttaaaaatgctgatcttgaaaaaggtgaaaaatatactctgttttacatatctgatcttggatctttaattactgaaaaaataacgtatgacagttgccagtcaactaaatatgctcaatatgataatgcagtgaagttgacatacaagcctgaaaataaaagaaatttatattaccgacacttctattcagaattattgatgttcaaagggtggcactcgctgcccgaaactgtgttgaataatgtagaggttaaaccagatgggactaaaataattcacagtaagtactactcgtgtgacaaaagacaatttgacgaggttctaaattacttaaataataaaagcttcaaacctctaatcaacacatataaacctagtctataaaataagaggggatgagaaaacatctcattccctaaaaagggagaacaaaaaatgtttaaagataatccggatttttatccgacaccaccacagttaatccgaaaaatgacatcaaaaatagaatggaagcatattaagtctgttttagagccgtcagcaggtaaaggggatttggtagaagctattcacaatcaattcaaatacaccaagaactatagagggaattcgaaatatgatattgattcaattgaacaagatgaaaacttaaggcacatccttgaggggaaaagttatagagtgatagcagacgattttctgacgtttaacacttacaagaagtatgatttgatttttatgaatccaccttttagcagcggtgttaaacatttattaaaggcgattgaattaattgaaaagcaacaaagatccggccaaattgtttgcttactaaatgccgaaacattaaaaaatccgtattcaaatgacaggaaatttcttatacgtaagctagaggaaataaatgcagaagttgaatacattcaaaacgctttttcgaactcagagcgaaacacagaagttgaaacagcaataatttacataagcattgaaaaacaagaatatagcagcgttctaatagaagaattgaaaaaagatgagtcacatagaattaatgaggattataaagcaacacagttggtggactttataaaaggaattgtagaacaattcaactatgaaatcaaagcgggtttaaaattaatcaatgaatacaacagtttgaaacccttaatgctgcatagtttcaatgatgacagtactccaatattgaagctgctaattgataagaataccgaagaaaatgacatagagaatgcatatataaaacaaattagggcgaagtattggaatacgttatttaacaatgatcaatttatggggctcttcacaagcaatctgaaacaaaagtatttggagcacgttgaggaattaaaagattatgacttttctttgttcaatatctatacattgagaattcagatgagcaaagagatgacgcagggcgtggaagatacaatacttaacctttttgaagaatttagccacaagcattactatgatgaatcatcaaaaaatgtgcacttatataatgggtggaaaacaaataaatcatataaaattaataaaaaaataattattccactaaacgggtattgtagttggctcggtcactatagtccaacagactacaaggtcttagaaaagttgaaagatatcgaaaaagttttcaattaccttgacaacgggttaacagaagacataaacatagatgaatctctaaaactggctaagcattacggtgaaacgaaaaaaatagaattaaagtacttctatgtaactttctataaaaaagggacatgtcacattgagtttaaagacaaggaaatgcttaagaagttcaatatttttggcagccaaaagaaaaactggcttcctccttcgtatggcaaggtaaaatatcaggatatgacggcagaagaaaaagacgtaataaatgattttgagggggcacaatcttacagtgatacggtaaataacgcttcttattatatactggatacatcgaagcttctcttgcttacatcataacaaaatacacactttaagaataaaaataaaataagtattgattatttaaaatagtcatgatatacttaaatcaagttaaaacaacagcgaaagcatacatattttaagggtaaaaataaaataaaatgcatattttaaacagaatggagacattaagatgagtacatatcaagtagatttcaatcaattcagaggaagtatggaaacaacatgcgacctatataatttagataacaatacaacgcttcaaaccagcctttaccgtaatactaatagcctttgcattgaatataaggtaattcagcgtgatgataattcaaatagttttgcggagtacgatacacttgcccgtggttacattgaagtacctttgacttacaatcaatttaagaagcctgtaaaaaaagtttatctaaataaaataattaacgcactagattttattattaatcaatatcttattatagaagatacttctcaagaaattaacgaacgagttcaaatgaaagtgagtgcaactaaaataaatgaggaagatcaatctgactttacgaatgaaacctctaattcaccaattgatcaaattaggatggaaagatgggacagggaatatgacgagggagttaaatatttctttgataaatacgggaataaacgtataggggatattatttatattgatacacagcaagagcttgagcatttagaacacatagactgtgataatgtgataaggatttttgtagacaaagagcatgaaaataaaattaaagctattgtacttaaagatataaacaaacattatcaaagaagtggataaaacaacaattttatacaggagatgatgaagtaatggcagtaatgaaagaagtgtcaatagaagaatatgatttatttagaaaatggtatttaaagtataccaatagcagagtcctaaaaacaaaacagagggcagggtttacggctgttcttgacaagaaaacaaaagaaactgtttgtagcgaaagtcatcttatggggaaaagtagatacttaattaaacaaaattattatgatttatatgcagaggaggatgcggagtaatggctaaatgtaatgattgtggtaatgaacgttttttctacctagaggtatcggtgggagccaaacagcttattgatacaacaggtggagctaggaacggaaagatttatgatgtagactattcagattcaggtatagacaatatcttcaataaaggtagttatatttgtaaaaaatgcgaatcgaaagacgtacatcatgaggatggcgaaggtgattataaactctataataaatctgaataaaacagcagtttaataggaaaggggaattatatgcgtgaattagaattattgctcttagtgatgtgggcagaaaatggtgttaacgaagtttataagtataaaaatagaatcaaggcattccgtgatccgttggttaatatcgagttgattaatgacttgagttgcggaggtatgtttgctgacattgacgacgttgcaaaccacaagaatgcttcgtcagtagattataaagtaagtatcgcaaccttagttgaaaatagaagataataagataaatattttattaagaggaatgcctgtctaaataaaaacaccatttaattcgaaacgcttctttatcatcgcaaagaaaaaatgtaaaatccacctattggcatgagttgtcaatgatattgagacgtcattggggggagaaatttgaaaaataaacttgaaaaattgcttcttgaaaagggtgtatgtgaatttcatattaaggaaatgaaggacaccaaaaatataagtgagtatccatatgaattgtattatgatgaagtcggaaacagcgaaaaactatatcgggatgtcccgttaaaaaaaattaagagtttaggattcaggggaaccagtggtgtgtcttggtttgatcacgcgtgttataacggtacagataatattgacattggccgatgtgaaaaagcttttgaatacttaaaaaaacaaagtctagaagaatttcacacttattatcaacactcaccagtgaaattggttcattatgaagatgatgacttttatgctgtttacggtgatggaacacaccgtacaatttgggccaagataacagaagctccaacaatttatgctcaggtaactagagcaagaaagaatccttccttatataaatcatacttaagatttaaagaattagaatcacagattaataggtattttaaggagaatgaccttagctggggagttaaaaaaagccaatactattcagaaatcctttacaaaggtatgccagtagcactctattctatagatccgccttactcatttaaccgatcttcctacagtctcaatgatcaaaagttggatacatggaataaggaattaaatgaatttatgattgagtttgaagaaagttttcgctataggaaaatctttcgcaatgttatgaaggttacgcccggaaaattagagcacaaacttttttcttttattgaaaatttaagtgaaagttggtctacagctaatggaaaggcaagaattataaaacaaggattcgatatgtattgcatcgataaaaaaatcatttaagttactttaaaatatgtacaacagcatgagggatgacgaagaaactaaaggagaagtgatgaaaaagttaataattttatgtttgggtattatcggggtatttcttatagttcagtgtagtaaatttaacaacaatacaaaagtttatgtggatactcaattagaggtaaatcacgatgatgaaaatgaaagaaaaagttattatgacaatgattcaagccaagaaagtgaagcacttaatgacaaatatttaaacaaagaagagaataaggaatatgacatttacgcatatgatttaaaaactagggaaattcaatcacgtaatggacaacgtgaatatgtttatggaggcaacgtgatctctagcactcaagccgaaaaatatggttatcatacaacaccaattactaaggaaggagataaaacaatcaaattttggaggaacgatgtaaagtttgttcctgaaaagggtgagattgtcctggttagatttcctaagggtaatcataaaacatttgttgatattgagcttatgtataagccaacaggagagcctaatggagaatggaattggtgaacaaaaacactactttattttaaaacgggaatcgggctgcctacataagaacagcccttgcagttagctcgcaatccttgttttgactggtttgtttttcttgatattacgtaatttaagagcgggtttttccactattctgtacgaaagaaatgcggatgcagcagtaacagcaattagggctatgatcagcgggtaatcagacaatgttttattaattccagtgtataagaagatgttgatgatcaccatgtgccatatgaaaatccccatacttatatcgtctaaccggttcagctgtcgcaatatcttcggcccattgtaaccaaaccagacgagtgcatagctcagaggtacgaaccataaaaagctccataaggtgctgtttattgaactgagatgcagaaggtcaagtttatagaataaaaataaaattaccgaagacaaaaataaaacgatatgctgcggtaacttgctccatgccttagcccagaagatgcccaaagtgaaataaaacatctgcggcaggaaagaatgtaagtacaggttaccgaacacactgccaggcgcgaactttaaaattatgaaagagactaacacactgaaagcggaaacagcaaaagagcaaagaatcatttttgggaatccgaaacgtttataaaaccaataaattgcgggtaacaccaggtaaaagctaatctgaacaggaattgtccaaagtgaatcgttaaggcgacctgtgccgatgtgatggaatatgtcagggaagtattgagggtataacacaaaattgctaagaagccatgtccagtactctttagtagtgaatactgttaatgaaagagctcctagaacaattaacaggatggtggagacgatagcataggtgtatatagcgggtgcgatcctaataattcggctccaataaaaatcggttacattattacctttaagctgagatctctcataagaagtaaaaagaaaaaatgcacttagaaaaaagaagattgatatgccggtgtgaaatattgctttgctctctggggtataaccaaagacagaaatatttagatctcttgtagcatgaccaatcaacacacaaagagcagcaaacagcctgataacaaagaaacagttagaatgttttacgttcattaaaagaacctctttcctataccatatggcgaataagcagtaaggctgcctataagcagtgatgattatatcataaaaatggaagatttgttcttaaaaatgaactaaaataaatatttttgttcttaataaggtatatttgtgtgatgtagggaggtatagatacttataaatacacgtagatattcatagatacatgtatatctagctatatcaaggagaatgcagataaattaagaagcctctgcctgttctttcacctttatttccaatatagtataatttggaaaagggggagagggaatgaaaaagctaatctttttggctgtgatttgcattggttttatattgagttttaacacaccaagtgctgaggcgaagcttacattagactacaaaaatgtggattttcacatgagtgaggattcagagagtttttcaatggcagattattttgatcggaattttgatcgcacttggctcttctacaaattcacaattaacaatgctgaagggtgtactctaaatatgaaaatcagtaggataactcttgctggctgggtatttccacgtagtgagaagcagtttgtagggaactatgctgactatactgctacagatcgagtagagggagatgctaatcgtaatcatgtgttagagattacaaagaatccaggctgcggagatgtgtggattaaaggtatttatggatttgaacatgaagattcatttgattggtaagcttgatacatagtcaaggtatatccttgaccttttttatggatataatgataatttaaagtgatcatacataatgaatgcgaggtagtaacattgattaaatcaaatttaaagccaatattagacgaaaggaatatcagtattcgaaagctgtccaatgatattgatcatggttttaacacagtcaggaagctgtatcatgatgaaatggagcggtacccaagggatctgttggataaagtctgtacatatttagacattgagctgcatgagctgttgatttacaaaaaagattaaaaagatattgatcacttaaagtgatcatggtatactaaagttacaagaacagtaaatacttacaaattttataggtctacataaaatcgtactttcatagggaaaagaggaaaagaaatgttgccaacttctttaaaagcaaaagttcagcgaattttattaaaaggtagctttaaaaaatctgagagctctaaaagcagagtaaaaggactaagcaatatttcagcgggtttcacttttgagaagatgtttgacgacggttactgcctctattatacatgcggtaatatgactttccggggaatgccaaacgaaaaaaaggataatcaaacagaaaaaatgtatcacttcttattggatcagggtcttcaaaaaaatattgaattgacagagtttggaaataaaaaagtaatcttgttgaaagtggaataattgcgagacactttgaggagtagcataaatttgcactttacaacaaagggagagataaaatgagagaggaaattcaagtgttacttgaagaaattgaagaattagaaatggctttaagtaagtccgataacaatactgtttctgtggttcttcaagaggcaattgataaaagacgcaatgaaattggcgaactaaagccaaatgggtacgtcatagcagacgtagtccttaaagacggtaccgagttaaaacggtgcttagtttttactgtaacagatcgactagggtcacaagctgtaactgaattagttgaagcaagagaaatcttcgaaaaagataaagcggtttatttgcaacaggaatatgaggatggaaactttgcaggggatataggagtacacgaaatagcaacatacaaccttgaatatgaaaatggtgttaatgaataaaatcattctttcatcttaattaataaaggagagtacataatgtatagattcatatcagagctgaatttagacgactcgacaattcaaaggatggataaatcccaaagctttaaatacatcggtggtttttatatgtatgatccccagcaaatcgaatggccaatcccagaaggagaatcatcttcgctcagtgatttagcccatttaagttttaattcttatgactgtgaaaaccaaatgatcgcggatatgaaaagggaattcactgaagaaaagttgttaaatatttttaattctgagtgtccagaaacagcttttaatgacgctgcttcaagaatcattgaaaaatataattaaggtgggttttaattggctagagataaagaatgggttaaaataagcgaactttctgaagaagaaaaacaaagcttgactgccggtactgcagttctgctgcatgataattactataatgggtcgtcagaaaaagcttccttgataagaaaaaaaggttctcaaggaagactagaagacaagtattacgaattgaacggtcaaatggttagaattcttttcggaagcagaatcttaaaagtcccttcttctttattatctgttccagttgcaatcgacagggaacaggaagtcgaactaaatctttcaccagtccaaattgttaaagttatgaagtcattagaactgttactagacttagacaaggaagaatttaaatttaatcgagaagagattgtcctattattggagcagctaagtaagaatctagatagtaatggtattgatcctaacagagtaatgaacgagctgttttcaaggattgattaagttgaaatgaaaccagtcttttaaccagttatgtaagtcaggttgagtcaggaatacttttttgaagggttagatatcaaatgacgatgctaatagcagttaaattcgacaatagcatagtaatgactgctgacaaaagagtgactactacaaatagcttgggccgaattttaaaagtggaatcagatgaatataagaaaataaaaattattaataagaagtacgtaatttcttttgcaggtagaatgtttattgcagaaaaagcttttgattttattgatcaaaaaagcgatattttgaacagtaatattgatccactcttattttttagagaagcttttaattacggaaaatcatgttttgaagcatattattctggtattaacccactttccgtattttttgttggatatattaaaccagacgaaagaccacaattgttggggttttcatcagatgataattaccttggattagaaatcgattcaagtattaaaattaattctaactcccctgatcacgaagacatgcttataagcgaaactgttaattttatttcaacagaaatgtcaaaccgtcatgcctatcatgcaaatgaaagacttttagagatttattcggaggcaataaaaagaaccaatgatccaatgatcggaaaaacaacttactctgttatcttaacttctacaggtgccgaagaataccatcattaatgtaaaacagcacgtaaaaattataattaagtgaggagaatgtaaatgatcaaggtttatacaagaggtcataagataccaaaaaagattaaatcttgcatctctgaatgggattattggtcttggattgtagttaccaatattgcaaagaggaacaaggatgcgaaacgactaatagagaagattgaaactgatccagacaggattgcagaatataaaactgaagatggaattgaagtttatgtaagctacatgattccagtgaaatagaaaagagcattaaactaaatgctcttcttcataccacatctacgacactcacgtaaaaacacaccacttttcactgaactcttgaataaagcgtaatcacagttgtcacagcgaccatatttaacatcgggatactccttataatcatatacaactgttacatcgtagccattagtctcaaaatctttctcttccattaaatttcacctacacaaagtatttaacactactataataccagacgatgtatataaggagggttttaatttgattggaatagcatatttcttaatgctctggcttggtgtaggctttctgacaggatttaaggccttatttgttgatcaggtttatgatgaagagtttaagcaggaactgattgattcattttcaccaggtatggagcagaatatgattgaactgttctttaagaataaaataaatatcatggtgttttacatattaattggattgctgccactggccataaaaattgctggtctgctgaagaggagttagctatgcctgttatcgataccttttttgttattcaatttgaaaatgatgattacttcaagtcatttaaattagatggaagtggttataagacatctaagggacttcatggcgcttctaagttcattacaatgtcagaagctttaatgatagcaaacgagctgcgtacagagtttaatgtcacttctgccattagacaaatcgaagttattactaggtgatggggtgttcaggtgtactggattgaatggattgaggatggggagaagaaaagtattgttgtggacggctgggttgaatgggccacaatcctggaagacctttatcagcagcggtttgagtatgttgaatggaagcggctttaaaagtgttgacagaaataaaaatacaactgatgagacataagaacctgaaaagttactaggggcatttttttggacagcagaagtaagatgagatatatgccaattgaagattttccaaagaaagcttataaatacatggaagcgaaatggttgaaaaaattaatgagggacaagaaactttttgtaaatcaccttaataactatccagagtcaagcttaggtgcggatgttggagatgaccaagaaggtgtagcaaacagacatttaaacattaaaaaatataaaacaggagaccataatccacaccttcacaatgaactacaagaatggtttcctgactcaatagttagacttgaagatgtgtcatttcaaacctcaataataaataaaaatttttatgtttattgtttaactttcaattatgataaaaatattatgagaaagtttggaggttcagtaatggtaattaatgattttccaagtttcgcatattgggtacacaataaaatgaaaaaaagaaattgtgccttatatgctgcgaataattgcatatatagagattcaaggagcattacttttaatgaggaaaacactgatttttatttggtgccaggccttattaaagatagtaagcattctgaacaagaagagtttagatttctttggaggaaaaacgataattctttaataaacagaccaattaatgatctttatgtaccagaagcattaaagttttgctcctttgaaattaatgaataaaactttatattgtttttatggtttacatactacgttcaattatacgtattgaatttgcaaactttttaaatgtatttataatcttctttaaggagttgatttaaatgaattgggtatcttacccctcaattttacactatgctaatgatggtattacagtaaccttcccagaccttcctggttgtataacttgtggagaaaatgatacagaagcaattagcatggctaaagaagctttaggtcttcatttatacgggttggaaatggacggagagaagtatcctagtccctcaccgttttcggaaattaagacaggggaaaacgaagttgtgtgtttgattgatgtgcctatgcatgcatttcgtgatgagtataggcgtaaatcaattaagaaaacattaactattccggcttggttaaatgaagtggctgaagaaaagaacattaatttttcccaggtgctgcaggatgcattaaaagataaactaggactaaatatctttaaggcacagtaaggattcttattgtgccggttcatataaaatacgaattttaaacagataagggttccttaaaaaataattagaataaaaataaaataaatacttgtaattctgacaactctaatgtatattataaacaaagggaacattagttgggaaggggtgtagtaaccaatgaatcttaagcagatgattaagaatgaatgtgaaaaagacaaccagctcgcagcgaaactctcaaaaatagcagggtacaaaaaggttaatggtttttacaaattcatcaacaccccagagaaagaaatggacaacttaggcggtttaattaatattgttaaaagcttgtttcctgataatgaggagcagcttctaagtgattacttcttatcactggatcccaacaaaaaatgtgccagacaatctgttgaatactcagatattaatcaatgggatacgttaacagacaagatagtgtcgaggctatctagctcaaaaaacctagcaagtcaagaatggggcaatatatacagtatacatagaagattgagcgaaagtaagataagtttaactgatgcaataagagcaaccggaaagtgcaaaacagatgaaatgttatttttctcaaatgctatgctgatgtatgagtatttgaaggtaggcgaatttggattgatgaaaagcacattatcacttctcaatttcaacgacttacccgaaggctttgtgaaagattgctatatgaatagaatttcattattaaatgcaaatatttatttaaatgataatgaaattgaaaaatctaggtattattcagaacaagttattcaaaattcaaatataaatcgactaaaagtatttgggcatctaacatatgggaacacattaatttttgaaagctactctaaagccaaagagcagtatcttaaaggattggaatttgctcgtgataatgaacatcataaatataagctgcgattagctctttgctttttaagcaacctatggaataaggataataaatggcttgacttcgacactgataatatccctgataagattgaggtagcatattactatactaataataaggaatttaataaagcagagaaagtaataaatgagcttgagaatatggaattgtacgaatatgattctgggattctagattacattaaggggattctataccaaaataagaattatttttatgaaagcactgcaaagttgaaaaaatctggtgataaattatttatcaatcttccattagcggagctaaggaaaatgggctgtgacgaaaaactacttgaattaatcatggtctaaaattgaaggggggtgaattaaatgaaaaatattattcttggaatagtaatcttgttagcaatggctgttggatttgttgccggacagcaatcaattgagacagcatcggtagaccatgtagaccagcctgtaaaagttgcatcaccaagccgcggggcttaacttcaaagataatacataacttggctagacgtttgatccactggatcaggcgtcttttctaattttaagagaatgttccagaaattcataatataaaaaacaagaacatgggggaattaaaatgaaaaagcatttcggacaagtactttcttatgaggatatggctaaggggtacatggaaatgggagatattaatttagaaatttcccaggaagataatcatcttgaaaatgaagcagaaatggttagatcaaaatataaagcaaaggtatcctaatgaagattaaagacaaatcagcagacattttaacacatacataggggatgtgttatttgtcttgaataaaaataaaataaattgttgcatattattctagcaacatatataatgaagttacaagatgaacgttgttgggagatgaaacaatggaaacaaccagtgccactcaaaaggaagagttgaagattacatcattaagacaatatcaatacataaaacaactaaagaacttcacacgagtcaatctccacctagaggatccagatgtgtttacacctaataatgtaactacaatgagaaaaaatcataaagaatacaacctcattaaagaacaaaaaaattctataaaatgtatttaaggagtaaaaataaaatgaataataaatattatacagaagaaaacaaggctaaagtttggaaaaagcatatgatcgttttaaagtttctagagcagcctgagatagcagtagcttataatgagttcctacgaagagaagcgacaagtgatgaatgggttgggttcgaagaggagctttatgaggaattgacggggatgccaattataaacgtctgtaaggacgagagggtaaatgtcctaaactgaattttattataggataaaaataaattaggtgtgataaaatgaatgcagacatcttaattaacgctcttaaagaatacgacatgttaaagcaaatggaaatctgtaacgccaatataatgctgctgagtaatattcaaggtgagaatgaatggattgttgcgtggaaagaatttgatcaatacttaatgaaaaaaatgatatgaggtgtcattatggaagctcaaaagaaagcgtcaacactaagggattattcaatatacaataacataaataggtggtttgatgaattagatttaagaaacagggatcgagaaactggagaaattgaaaagtctaatactagagccacgtatgaaaggcatataagagagtttttcaaccactatgctgccaaggatattgaatatttaactgagagtgacctggcgattaagaagagtgacctgtatgattatcgaacccatttggctaaaaataaaagcaactccaattcaacaattaacaataagattgccgcactgaaaagtatgattaagtaccttgaatctgaacatgagtgtgatgcatctgtatttaattttagacctcttccaacagaaaagaacccagcaggctcttttgaaggaatatctgaagctgatgaatttgctgaggcagcgtatgttactgagcgtcagaacagattaatgaaaaagatgtttattttgtttagtgcacgtactggtggacgtaaatcagaggtacttagagttgggtgggatgatattacttattcagaaaagcaccaatgctatctcgtcaactttaaaaaaactaagcaaaaaaaggctagaccagttgggatttccactgctttttatgaagagttattgctgttaaagcaagagtatggggaacatgagcttttatttcataagttaacagttgattcaatacaggatatgtggaatcgcgtatgtagagttatgggcattcccaaagaaagaaagataactccgcatagtttacgcaatactgcaacaaacttttcttacagcattaatggtgatattaaaaaagtggcagcgttctctggccacagcaatatcaatactttaaatgaccattatttagtcaatgaaagggattattctcaagatccaggggttttggttgatcaaaaagaagacatgtcctttttagatgatgttaccttagagcaatataaagaattctttttaaaatcagacatgtatatacagaataaacttaaaatgtttttgaacaagtgatacaaataatcatataaaagctttacttgcttatgaaaataatgataaatttaatatgattatgtgaggtgataatgtgtctgaagttttgttgacaacggataaactttataagttaaaaactgaaatagagaaaaatcttaatgatattaaaaatgatcccaatatggtgaaggaattaaaagccacaatggcggacaaatacaaggcactccctggttatatccaagaaattttaaataataatgataacaacgtacagcgtttaaacgaaaaagaagtgtacattgtttcaaaagagttgtattcaattcttgggacgcaagctttagatccgtcaaattattttccaaccagattggcaaaagagcttgaaggtgggagagtattcgccggtgaagaagtagttaagctcccctacaagtttaaaaatgtgattaaaattaaagaggataactatgtcacttccattactgccaaagaactgagtgagttatataatagctccatcctgcagtacaattacaacactcagcgagaaggaaagtacattaagggcagccttattcctgtacctaaaacaaaccctaaatcagttgatgagatcaaagaattgtttattaaaggcgatttaattgtatcaatgttaacttttaacgctcgtcttggaacatctgatggtgatgaagaagttgaatatgattcaagcgaccaaaccctcactgtaacacgaggaaccttattagatgctcttgatggatatcatcgaatttcaggtattgttaaggccattgctgaagtccctgaattagatcaaccattcattttaaatgtgctcaattacgatgaagaaaaggctaaggttcactttgctcaaatgaatacaattaacccagttgaaaaatccagaattgaagaattgggtcaaaaacggtattcttcaaccgttgtcgagcagctgaaatttaaaagtgaacttaaaaataaaataagcccacaaagtgaaattgctattgatagcaattttcttgtaacatattatactttatccgaagctatagacgatgtatttgagttgaaatctcgaaaagatgcgttgaaaattgcgaaatacttggtagacttttttgataaccttttttatgcattcccagacgaatttcttgaagatgatttatcgtccattagaaagcaatcatacattaatcataacgtaatgttttacggttatgtttatttggccaagaagatgaaggaaaacaatgtagaactaaacaagcttgaaaatatccttaatacgattgactttagtaaaagcggaagagtgtttgaagaattaggaagacaaaataatgagaatcaactaaagaatattatgaagaagaaacttaagcgaatgttttatgatgaaattgctgttgtttaaagcctaaaggagaatttaatatgagtgaaatatataatgctgaattgaaggaaaagtttttagagaaatacgaaagtgaagcaacaagaaaccattattggctaaggctaagggatttctcagctacagaaaaaatacttcaaaaagacatatttaatttttctttggaagagctgcgtacgttatttttagatttagatagcaaatctatagattcactaagaggagcaagagctgtaattggacaatacacaacctgggcaatggaaaatggcttggcaaacagtaacatcaacaaagtgtatcagatacaggatggtgacttaaagcagtttatagataaaaacaaaaaaacactattcaccaataaagaagtagaagagtatgttgattttatggttaatgatcaggataaagcgatgatacaggctatttatgaaggcatagatggctatcagcattcagagttactgaatttaacaggtgacgatttacttgatgataacaaggtaaagctgatagatgataaacacggtgtaagaataattactgtaagcgataaatgttatgagttgcttaagcgtgctaatgatcaaacaacttatcatcttagcaatggttcgccagatagtggtcttaaaaacaaatttgctacattagttaaaagcaaaaacatttttaggctaaaatacaagagttctaatcagagtatgaaagctgacaagtttttagttcaccgatcttttagccagtttcaaaaatttttagaagaacccttcttttcacctaagaaccttatcaactcaggaaagctcaacatggcgtatgagatatacaaagagaagggtgaattaaaagtacctgattataaaaaaataactcgacaatacgggtttctgaatgaagacgcggagtttaattcacaatcactgaggaaagtagtgaatatggataacttagaaaaatattgtatcaagtctgaagtaattgagactaattcttaatccctgttgcagggattatctttacataacttttagagtaaaaataaaacatgtgcggataaactcgtgatattttttcgaaaaatatcaggattttgttcacatttttcagaattcgacaaagttagacagagacaaatttgtacatatgcagtaaaatagttctataccctaaaaagggtacaaggaggttcgctaggccaaactccctagcgataaagtcaatgtttgattttccattcatagagatcttcaattgaacagttaagggcaatagcaatgattttcgctgtttttatattcatagaaggtctaaagccgtttgcatagtcacttaatctttgcgtactaatgcctgttcgctttgaaagttctcctaatgacattcctttactttcgaggagaatggaaatcaaacattgtccgatttcaacctcaagcatcggacaacctcctgttatagtattgcttatcatactatatcaattctttccaagtttttaaatgaaagaaaaaagatttgccactaactaggtaaaaggttataattaagtcaacaaaaagggaacataagttcggttaattactaccagagagagggaaacgtatgtcagaaaaggattattttattcaaggggagctgtgcattcctttttttggcaggataaaagccaagaatgaagaggaagcactcttgttcgcatatcaatcaattaaaaagaaattaagaaacaaaacagggaaaatggggtttcttcaaaaagatcaagaaaaatatgaggcactatttgatgtagacatcatgtgtacagaggatgctgaaataacaacctcttatgccgaagaaatagacgattcgtttgaaaatgaaggctataaatcttctcaactgttatcaataaaataaaagcacatacacatcttgtcagtcatcatgagacataaaaaattggtgactttttagtcagactggagcatacaatggattttaatcttgaaattgacttgaaagacattatgagatcagtttccatgagtgttggttctaagaacatacaaagtggagagtactacatagacattatctttaaaaacaatggggattgtttgaggattagaatggatcatgcttcagttttagaatttagagacaaaataaatgaaactctttggaaactggacggcatgaagacgtttatgaagacagcagctttacagtatgagtaaagctgatttttttaaaattatttagaataaaaataaaataagtatttacaacatatggttgaggttatataatcgaattagaattaggaaaggagatagctttaattattgattaatgaaccaactaataatcaaataagaaccatggttttaaagaaatatgcaaagctcttagcgtcatgtgaaaggtcattgcgcagcatagagaataacgaaataagaatggcaattggagacctagattttgttaaagacaatttagaggaaatacaatacatactccgtgatgttgtgaatcagcatgaatgtattaagagtaaaaataaaatttaagttttatagagattaagataagggggaataacatgggtgcattaatcgctaagcaaccgaatggacggtactgccgatttagttcagtggtagactgtccaacgcacataaatatgacgcgtgaagactatttaaataattttactgggacaacaaaaggaagggaagatgctgaagatacacttgcaaattatctccggccgtttcacgaagttataaagtggtacacaccgctgaacatgagcgaaaaagagtttgtggaggcgttaaaagaaatgtgtgacgaaaacccaaaggaggcgcgggaattgtgaacacagcatacagggtgtgggacggcgagcagatgcattattgggatgatgaagggttgagccttaccatcaaaaataacggtgattggactttgaaacgtttatacacagatgttttggttcccgttgtagacagcacgaatagaaacgcggctctcatgtggggcacagggttgaaggataaaaacgaaaaaatgatttacgagaaggacgtcataaagtttaaatctgtctattgcgaaaacaagattataaaagcagtggtcaagtttagagattctcttgggtcgtttgtattcaataggggagacgatcaagacttttggagaatggacgtatccctaagtgaaatcgaagtcatcggagacatttatcaaaatcctgagttattggagggcgcggagtgaatgctgaagtaaagcgtgttgaatataagctgtggtacgaagttaagtacggatggaagcatctcagtttcggcgccaatgatgataaaactgcattggaatacgcagaggaatacgcaaaaaataactacctcataaattataaggtggaaaaaataacgaatgagagattgttttggactgaggagggcgcggaatgagtaagaggtctaccctgttattaaggaatagtgtgaaagcaggacaaagagaaaaattcattacaaatggcattccctatgatgaacttgatacacaaatgatcaatttaattgatattttgaatttcatgattggattgaaaacacgccactgttgttttggacataaaccatatgaggaaattcaagtaatgtttgaagaagaagtaaatttaaaagaagatcaaattctagagttagcggaattagcagggagagaatggaaaggtcttcagttaagctttagcaaatgggcgagattttctccattgatgtttaattggtcattggtactatcgaaaagatttagagatccagaagatccaaataaaaaccgttagctaagatcagttgaagaattctttgagagctatgctgcaaagaagtgattaaaagatgcattttaaacaaataaaaatcagaaaggttgatagaatttgagaacattagtgttattaagaggctgcccaggagtggggaaatcaacttggatcaaagataatggacttgagcaatacacactttctgcggacaacattaggctactgtttcagtcacctgtgttaaacaaaagtggaaaatatgaaatctctccgaaacacgataacaaagtgtgggatttattaatgaaattgcttgaagacaggatggatcgcggcgaattcacaattgtcgatgcaactcattcaaaacaaagtatgatttcaagatataagccactagctcaaaaatatagataccgtgtacatgtagttgatttttctgatgttgatgttcggagaatcttaaaaagaaataaaatgagggctgaacataaacatgttcctgagagtagtattctaaatatttatgaaagaatgacaacagaaaaagtgccatcttgggtaactgttctaaaaccagatgagttcgaaaacacgatgacttataagccaagatgttttgacgattataaaaagatccatatttttggagatattcatggctgcaatactgtgcttcaagagtacttaaacggtgatttaaatgaaaatgaactatacatctttgtaggagatcttatcgacagaggtattgaaaatgcacagctgttagaattcatgatcaaaattaaagattataaaaatgtgattattctggaaggaaatcacgatagatatatcaatatgtatgggaatgatgaagaaacacctagcaccacatttaacaacaaaactaaacctgaaatcgaacaatccaacattgataaaaaagacattagacagttggccaggaagtttcatcagttagcttactttacatataaaaacactacatacattgtaactcatggaggagtttcaaccgtacctgaaaatctcttgatgaccgcaacaacacaattcatcaatggagttggagattattcagacgatattgattatgaatttgcaaataatactgcaggtcaaaatgttgtacagattcatggacatagaaacatgtaccgtctgcctgtgttagcagcagaaagatcatataacttagaagggcaagtggaaagaggaggtcatcttagagtcgttacactgtctgagaacggaattgaaacgcatgaagtgaagaataaagtctttaaacaaatttcaagtgaagtacagagtaacagtgcaactgttggaacaattgatgaattgatttcacacttacgtggtcatgaatatgtgcaagagaataagatgccaaacaatatctcttcatttaattttacaaagcaagcatttagaaagaaaaagtgggatgaaacaaatattaaggcaaggggattgtttattaatactgagagcaatgaaattgtaagcagaagctatgataagttctttaacattggggaacggtctgaaacaagaatgcatcatctcgtggatacaatgaagtttccagtaacagtcttcgataaggcgaatggatatttaggaactgtagggtatgactctttgtcagatcagttggtattcacttctaaatcctttacgtctcaattaacaagtgaacatgcaaaatgggttgaagatatgtttttcaagtcctttgatgaatttaaagtaaatatcattaaagattatctgaagctaaataatgtttcattcgtttttgaagtaacacttccagaaaaagatccgcatatcattgaatacagtaaagacaaactagtcctattagacatcgtaaaaaggcaaatgacgtatgaaaaactcccttatagtgaagtgaaggcagttgcagagagtctttccattgagtgcaaaaatcaagttgcagagtttagtaactggacagatttctatagatggtatctggacgtgtcacaagacttttcaattgaggaagagggttatgtaattgaagatgatgccggcttcatgacaaaacttaagctcccttactataacttttggaaacaaatgaggggattaaagcataagatcagcaacaaacatgagcatacggttaatacaggaagcctttacactcctttgcataatagattttttgcatgggctaagacaaaggacagaggatatctaaagtcaacctccattatcaagttgagaaatgattttgaaaaagaaactgtggtaatggaatccagatgaattcaagataaaagtaaaattttaaagagaaaggttgatgggaagatgaaatttgcaccaatggataaagttaaatttaaaacagctagccatttcaacaaacttcgaacatttaaaaaaagagttcctgaatttgacgatcctttactcggtgattgctgggaatttgaagaagatgggttaaaacaatttgattgggaggagaattacgaatttgtcgctaggcccaaacattttaattgggattaaaaataggatctaattgagtttttaatgaaaaggagctgttataaagtgaaagatatccgagttgtttatgacagaaacaaaactttagaagcggtcgttgtccagtttggagctatatgtgtgagctagtagaatcgcaattaattgatgaagaaactaaagaattcgacgtacttaatgatgaatatcaaggaatttggaaatatgaaaaagggcaacactgcgaagtcgaaatttatgatggggtagacaagtgggtttgtcaagcattattaaactgaataaaaagtaaaatgttcttcagatgatataaaggaggggaaataaagatgagggaatcacaattaagggaagaaaatgaaaatttgaaaaggcaagtagatcatatgaaagaagtctataaagaaaatatgcatcttcatatggcagtaagacaaggtgaacagttaaaagctaacctacaagcttatttacgacaagatgaccgagtatatagtccccatttcattacaccaaaacaaaaacaatatatcgcaaatttgttcaaaaaacatggcttgtctccactcagtaaagcaaaacgaaaaatagttaggcgttttaatgggggcggtctgctttcagagcacgaagcacatcaaattatacaaatgtatgaaagaaagtaatgttaatcttgacttggctggttcaactgtaaacaagaaggaaagagatttttaattgtagttatacagtcacaataaaaagactgttttaaagaaagggtgagaaccgatagtcactttcaaaaaacttagtgatcctgaatatattaagcagatggaaattgaaagaaatgaacgtgagcggatatatcaaaaaaaggagactttaagaaagaaaacggtgtgcttcactggtcataggccgaacaaattgggtggatacgatatgaaaaatccaacaatgcttaaactcaaagataagctgcttgaagtaattgaagaattaatcactaaggaaaacaagtccagtttcataactggtggagtgttaggaactgatcaggctgcttgctggtgtgtacatattctaaagaagaaatacccacatattaaaaacataattgcaacacctttcaaagaacaagataaagtgtggtctgaagaacaaaaaatgtggtacaaacgtatgcttgatgtggcagatgagattattaatgttgaagaattagataaatataaagttagtggagctgtaccaggtgagttttcaccggctaaaatgcaaaaacgaaatgaatacatgattgatcacagtgaagcaatagtagctgtttatgacggaagtataagtgggacaaggaactgtctgaattacgctaggaaaacatacttaggacatcaaatttggaggctgcatccgaaatgtgattttgaattggatataagctatacgcctgaatgaggagggatataacatgagtgaatttaaaattgtgaatttagatggagttaattggggatcgcataatgacgacacgttagatttcaaagaattgattacaggaggaacgattgcagtaggcgacgttgttaaagttgaaggacggggcgattgcccacttcctctaagggagaaccaactttgcataacatttaacaaagaaaatgagttgtttcttgaagaaccattcacccaagaagaatgcaaatcattattcggatcagattttagctactaagcaattactttaaaaggattatttcaatgaaatgaggtgggaatttgagtgagaactataaagatccgagacaagttgcgcttgagcttgtaaagaaagcaagtgatcagattcgctataccaatgatgatgaatttacatttgaagtggttgataaattggaggaaattgaggatatgcttaagaaagatattgataaagaaaagaagaattcattgaaaaattagttgaaaggatgtcgttagcataggatacatcaaatacataattgatacagcctggtttaacttagtttggtttaagtggcatcttggagcggatataagcatatttgatggctgcggatggaatacatataaatatttaaagggtaaaaataaaataagtggaggttataaagatgataaagaggaatctgcttagcaaccacgttgatgagattattggtgaatattacgctgctaaaggatattcagtccatagcattgaccgccaggaaaatggacaactgatcgttgttacagagcgagtagcagaggagaaggaaccggcacaagtcgatattgcgtttgattttgtacatagaagaccacataagaagaagtatttagcttaaaaacggcaaagagtcaaagctctttaccatcaggtgatttctttaaccgattcgcaatgtacttcattacgtttactgcaatcgacactaatgcaataatcaatgctatttcaaataagaggatgtatccaaaattcacattaagcttttcaaagtaatcgctggtaatagagaggattttataaatccctagcataaaaacaataaaggaaacacctaaaattacaagtgactttatagaataatctttagtatgttcaaaattatagataattattgatacaaataacaaacccgtagcaatcttttgggttagcgaatcatcggccgaaaatgattgcactactatgctgatgattaatccagcaataccgattgttttattcaaggaatcacccactcgtatgtaagttaggtatgagtttaccaattaaaggggattttctcaaggcaatacacattaaagttaaattaaaatgctttttaagaaaggggtggaaacatgcttggttatcagaaagggcagcaagtaagatggcatgaaaatggggaaatgggaattatattgtgggtgacaaatcaaggctctgtaggtgttaaatggagctcgggtgaatacggtgaatacaattataaagttgatgagttattactgttaacagattagtatcttacccaaaagtgtgaacgcatgacagcaagaaaaaggtttagtctacataaaatcgtgattttaaacagaataggaggaaacgaatgaatcaagatattcagtttttaaaagaacttcagcaagagttgaaaaatcaagacaacgacggacaagctgcaccacgtttctggacagttggtgattatgaatgggtcgaagctcgagaggaaaatgcagaacggtattctgtatacctgccatatattgcagaagcatatgttttagatgattatttggaagatttaaaagaagatagtgagctatctaaggaagcattaacagagttgaaaaatgacgactttgatgatcctattgagtggattcaaaaatacattgatgaagaagcagaattaattccagaaagaaaggttcatattgtacggccggatacaatgtttttgaccaaagaagaagcgaagagccacatcaatttgaacaagcatcactacacttcagaagctcatacttatgcaatgacagcttggagggcaccaaaagtagagcagttgcttaacatacttgaaacgtttgattggaattcaattaaagacagtcaatacaatctataaggggtgggaaaatgaatacatatgtagttacaaaagaaactgaaaattatctatatgaaataaataaacaaattgtttatgccggtaataataaagatgctgcctttggtcataaacctgaaacaagtgagagcagactaattttagacgtctggtttaatggcctaattgttaaatcattcagcagaaatcctaatggaaactggcgcgttttatttgataaaatggcaatcgcgaagaaagaagttgaagactacagcagaaaattaaacaaggcacaagagcttgtagagatgatagagagagctgaacaagtctagataaaagataatttttaatcagttattaggaggaaacgaaatgaacgtaaatattaaacggttatcaccggacgcacagattccggcttatgcgcacgcaacggacgccggcttcgatttagtggcgtcagaggacgttattatcgaaccgggctgggcagagcttgtgccgacgggtttggcgttcgagattccggagggatacgaaatgcaaatccgtccgcgatcaggcattacgctgaatactagactgcgtgtgcaactcggaacagttgattcgggctatcgaggagaggtcggagtaatcgtcgacaatataaatcgttatacagatattgaaaaggactttcttttcgatatcagagataaaatcgtcagtgctctcgattacctcggagcttgggatcattttgcgaaaggttcgtacatcatccgaaaaggcgatcgcatcgcgcaagccgttatcaagccggtcgagcaggtggtatttacggaagtcattacgctcggcgatagcgatcagaatacgagtcagttaatttaaagtctgaatcgacgcttttcctcaaagtcttcgggatactcattctgctttgacttggacttgaatacaaaccaaattatagcacctagtgaataatccatgactttatcaaaaatccaagttgtgaagagatccataagaattttcattgcatttcacctcccgagacaaaaatgtcctatctctcttagatggcatgtgtatgacacgcatctattaataaaagagtgaaaagtaatatgaaaatcaaaaaagaattgaaaaaaataaaaaagaggtgaaaaaatgatcaaacaagaacgagaagattatataagcaggcttgatgaatatggattgacagaagaaggggatgagggaatgacgaatattttgaatgattttgtaggctatgacatttggtgattatttatgaataaaaataaaatagttatttatagaagggaagggcgcagatggcaacagcagagcaattgaaacgaatgaacgacataaacgatttgatcaagcttatcgcaagtattgatagatgtactttctactgtaagtcaaagaatcggatagcgtatttcagatttaagaaaaaactgttcttcgttgatgattacacgggcgctgacgtttacccatatgaattgggatacgggcgtgcaaatggtttttcgcatgggggcaacatgtggcaactagtcaacagcttcagaaaattcatcataacagggaaatacggcgagctgagggattataaagaaatatgggcttacagctatgaaggttgtatgaaaatccgtcagaaggcgaaggagatcggtttcattgaaagtgttgattacccctacagctttgctgaatgggcaagttaaactaattgattcatgtactaaattttcatcaaaattaattaactttgagctaaggaattatgtaacggagagattagactctccaggattcaaaggaaggtatgcggagtttaccatgcttagtcttaaatctgtgcttaaccttacataagatcggttctacaaatatatattcgtcagtttcagactttacatgtttcatagagtggaatttacttcgttctgcgttcggcatgaattccattattccggctgcagtaccatcaggataagacagaagaaattttatatcctctttggtgtagccggtgataagcacatctgtgtaatcataattaatcactttcagccagctatgggaacgtttattgatttcataaggggagttagctttctttagtacgattccttcaagatgcttttctttggccagattaaagtaagctaatccgtttccttgtagaccttcgattacaaatacattatcatggtcaaggtttaggtctgaaagcatactcttacgttcagtgagtggcttagtagcgattgaatgaccatcaatataaactacatcgaatacacagtaaaccaccttatgagctgatttcttagacataaagcgttccataacagcttcgaaatctggagcaccgcctggggcagctacaatgatttcaccatctaaaacagttccattgggtatattaagatctaacagttctgggaacttgcttgttacttcgttgttgtgacgagtataaagctttatctgatcattaaacttggagaggatcagtctaattccatcaaacttcagctcggtaatataatcatcgtcatcaaatggttctttgattgaatgcaataacattggcgatacaaacaaaatatcacctcctacttagaacataatagctaagcgaaggtgatatataaagcaaaatgactgtggtacttaatgggattcaatcagttccggtgagttgtttttaggcgagttaactaaggatgaaacttgataagcttccatgtcatcagcatcatacggaagcagtaagctttgaagataatcaggatcggtgtttttggggtttagccattccttttcgttcttgtcagtaagaatgaccggcatccgatcatggatgtcctccatcaactcattgggttttgtagtaatgattgtgcaggtatatagcggattgccttctggcgtattccacttttcatataagccggcaaatgcaaagaggttggatgatttaagtttaatcctcataggaaccttagtctttgggtcaagacgcttccattcataaaaactgtccgcagggatgatgcaacgtttgctaacaagcggttttctgaagcaaagtttctcggccaatgtttcagctcgagcattgatcattttatagccgatcttttcatctttagcccaaggagggataagaccccatcttagcttacccagacggttgtttgatccatcattaatgattgtcaggatgttctgtgaaggagctacattataacttggatggtatgcgtcttcagacaaaaattgatctatattgaactgttcgatgatgtcgtcaaactcagaaaataaagtgaacctgccacacatgttcatcatcctttagggttttttgaatattgtacaggcttgatacacgaaaatcaaaaaggaggaatgtgatgcagcggcaaacagttgaggtaaaagaagttgtagtgttgatcagagggatatggacaaagaagaagttcacggatattgaaaaggggcaaacctttaagattgtggagaatggaagagtaaagaaatacatagcaagaacagatccttattgggatgagatgtacgaagcctacataattgatttatttgataaaaataaaataagtggatgtgagaataatggcgatcaatttaaagattagaaagaacaaagcagataagccaaaggtgaaagatttagaggacgggtacttcattaaaatagatgatgctgatgtatacattgttagaacactagacagagagtatgccgctaaagataaacatgaagttattcttatcgatctgagcaccttgcaaatagcgccatacaaggatatgaaggaattaaaaagtaggctgtctaacagaggtagcacagttgaagttatcagacctaaacaagcaaacgttaatatcggttttgagtggagacaataaaaggaggtggagagaatgagagatattaaatttcaggcgttggtagttaaacatacattaagcaatttgggttctaatatgcattgggcaggtatagacagttacgaagaaattattgatgttcatgacatttcttttgataacggaaaaatagattacgttacagataaagacggtgatgaattttcgtttgctgataaaagtttgaaatcggttcgacaatacaccggattgaaggacaataacggcaaggagatttatgaaggggatataattcggattactttcgacaccacatgggctgaagaaccttattacgttggagaagttaaattcttggatagcgaaaactatccagcatttgatttaaggccttggattgattgtgagatgaatgctttgagttggttaaaaagcgaatcagacccgactgtcatcagttatgaagtaatcggtaatatttacgaagatactgagcttttcgaatctaaataaaacagagattttataaggataaaaataaaattaaaaaggggaaatttgatgaagctaattggtattaaaacaagtaactgttttttggtgtctgacaatattgaaggaaagaaatattttcatagtcaattagatgaattgtttttcgatgggaaacgagcaactgaaacgtataaatcagactggtttaagcttgataaggagccaagtgttattgaaaaacaaatgcctgctaaaaaaatcaatcataggtatgaattaaaagaggggttccaggaaactgatttgacgccacaagtaattaaaacttcttacataggtgaagacagtgaatactatgaagtgaagggtctatataatttaaaatttgaagaagtcccgcaacagaatcaaaaaattgagtttgaaatgaatgtaattgaagaaattgacggagaacttaagttgcaaagccataattttaacttgaattataacttactggatagaattcaaactcatccaatgcttcttgaaacaaagccgtgttacttgtcccgagaagaaagctataagattatcagaaaccatataaaagccaatataaaccctaagtttgcaagaatcacgagtgattatgatttctgtttaactgtggtcaaagttttggagctttgcaaacctcaagagtacgtagttgatctaaatacaatgtacaaacgtagaaagcctaaacttgagaaaagatttcaaacaaagcgggaagttgaaatttacaatgttgcacctaaagcctatcagagctacccaattgtagaaccgtttagtggcaaagatgttgaggatttaaagggcaatattaagaaatttctagatgatctaatggataaaattaatgagcctttagtcgaatgtaaatgctgcgaaggaagaggggttatcttaagtgaaaattaaattggacaaagattacatggtaaatgaattgcggctgcctgaatcctcaattttagaagaaatcactgatacgtctaggtggagtattcattatcgtattgtgtttgcatatcaagacaagttttatgagacaacttacagggaaggcgctacagagttacaagaggagagaccatgggaatacgatgaccaggttgagtgttttgaagttgagcttaaggaagttaaggttagaaaatgggtaagaaaagaatctaaataataaatggaggcggaagaatgagagaaatcaagtttcgaggaatgggcatcaacggagaatggtattacggcaatttatcaatcattaagcaaagaatcaagagtatgggtattgatcctggttcttatatctctaataaagctggtgttccatttgcttacagtgtcaggccggaaacagttgggcaatacaccggattaaaagacaaaaacggccgagagatttatgagggggatattttaaaaagaacagtcacggttgtcatgtacggttcaggcaaaccacctaaagatattgatgaatacttagaagttgagtatcgggaagattatgcgggcttctatatcggagaaaggccactgtttgcttatgtggacaatactcgtgatgtcgatactggctgcagatgcagcaaagcagaagtcatcggcaacatttacgaagatcctgagcttatagagtctaaataaaaacgatatttaaccagatagggagatgtttaaatgacttcagaagaagcaagaaattattttgtgcaaaagggacttagttatgaagacattacggagggagatatttgtgctttagttatgctactcaataagcatgttaaacaggcagttaaagcacatacaatgtctgttgatacaatgagaatgagtcagaaaataaaaagcaaatacaaaacaaatggaactttaaaaagttgttatctttacataaacagtcactattttactcaaagagaagcaattagttttaatccagatggttttattggtttcgcagggtgggcagattcaggcaatagacaacctataattagtgcttttactgaatgggttgattatatgagtgaacagttaagacaaatcagttaaaagtaattttttatttaagggggtgataacgatgtgatcgatttatatgatttgagttttaaaaataaaacaaaaataaaaaggagtggttattaattgttgaggattaaaaacaaaatagaggaattgctaaaaaagactaaaggagcagaaaagagagactttggacggtacactctaatctgcacacttcgcaaggttacgaagctattaaagtatatcacagaaaagaagtcttttccagtattggtgacagcattggtttcgttcatgaatccaatcagtatcttagcagcggacaagtatcggaactttgaagagcttaaagcgaatgaatcaccgttcaattttagcgtgttctcaaaagagcaagacactgatgtattaattcttgctccccatggaggtggcatagaagggggaacaagcgagcttgcaaaggaattaagcgaaacatactctacatatctttttgaagctttaaagacaccaggagcctttgatttgcatttaaccagtacgaattttgatgaaccacaagcacttgaaatgttgaaggggcatgagttcacattgtcacttcacggttatgcaagtaatgatcaacatgttctagttggcggcacagaccgggacaaagctgaagcgataacaagtacattaaataatgccggctactctgcagagcttctagatgagggtacgaggctatccggtagcagtccaaataacgtggccaataaaaataaaacaggaaagagcattcaactggaattgagcactggactacgcaaatcaatgttcaacaccttttctctgaaaggacgctctggtacaagaaatgagactttttataacttcattgacactctatcagggtttctcaatgaaaatgtagaagggaagggtttgacaacatgaacatgcaacagcccttatactattttgttgatgctctggattggggaattgatgataaagggtcaaatgcaattgaaacaacagaaggattaaaccgagctttagagtatgcatgctcaaaatcattctataaagtatatgttccaaaaggtatctacctaattgatgcagtgaatacgtcaaagcggttacctgaattcggtggaggtatcaatgttccttcgaatattgagctaatacttcatccagaggctatatttaaagtgcagccaaatgattatcagggttactcctgtttttatatcggccaagcaagtaatgttacgattcgtggcggtcaaattattggggatcgacatgagcatgattattcaaaaattacctcaattaagaagacgcatgaatggggctttggtatccatgttaatggaagtagcaatgtgctaattgaaaatgtacaagtttctgactgtattggagacaacatttggatagcggctgatggaatgatgaacacttcaggaacatatacgccttcaaagaatgtaaccgttcgaaagtgtacgcttttaagaggaagaagaaataatctggctaccaatggttgtgaaggtcttcttgtcgatgactgtgatatagaggaagctggaggagatacaattgggccacaattaggaattgatttagagggctttggagaaaacggaattaaatacgatcacccgtataaattaactgtgcgaaactgcagatttaaaaacaatggacgtggatctgttacagctcacacaagcggcaaggtaattattgaaggaaactacagcgaccatgttatttcctatggatatagcacggatgtcagtatcaaaaataacaagatcatcaatgaaaatgaaattaagacttatggaattgactcggtaggtgtttcaagtactgagtctggaaacagagttcaaattgatggcaatacgattagtggctttgaagtgggcatttgtgtaagaggaaagggtggcacagtatcaaataatacttttgaaaaaataaaagcatgccctattgcaacacatcaagcagaggactttttaattacggacaacaggatagaaaacagtgattgtgttcaagtccaggttagaaactcaaatgatattaaggttgtgaataccaaaggaaaaggaacgagctcgtcttatgctgcaaagataatggactctacccgaatcagtctcgttaataatgagtttgctaatgtatatggtggaatttattgcgaaaggtctcagtcagttcgtttaaagggaaatgacttgttgttaagtgggagtggatacggcatcttttgggataaagactcttctgtctcactgcatcgaaatgaaattcatgagcctaggaatgttgcaattaaaggcacccctgagaaatacagttgccagattagtgagaatcaggtttatttctgtaaatcattaatcgccatccaactgactggtggttcagaacatatattaaaggataatgagatcatgttcaatcgttcagcagaccaaggatatggtgtttatttggagaatacaaacaaggtacgtctcgtaagaaacgatgtgcgcggaattggtggcaagttattatcccacccatattgcacagataaagcaaagaatacaaccttaatttataacacatatgacagtggaacactgaagactgcagaaggagatattgtggtctaaataaaactgtagttttaacaagtttaggagatggatatatggccaatattttaaccaaagaacaagatgaagcaatccggtatttcaagaacaagctgaacatatctgaaaaactgtacatatccctgattaattttaatctgcttagagataaacacgaagactttggtaatagactatatgagctttataagacagacccttatctgtatatcagagcgcttaaagaaggttatgtggttgatcagccaattgaatttaatgaagcaattgtgcggttctatgatggtgaagaacttgctgtgatccataagactactgggaagagatacaatgtgaatgttaaaatgaaaaagcttcctgatgggtttacgctgcaaacaatgaacatgtggtcttggagtgaggttatttgattattcaaactcctttgtaaatggtataattgaattaataaaggagtggtattatgtccatcaattctattggaggctgagtcatgggagttagagtgggaggctaataagataaacattttgagttgctatttaagcggctcttcttttatgaggtattctaaaaaatatcgtcgataaaggagaaactgatgaatttcttaacagcaaaaaacgagtacggtgaaacggtttactttaaaactcttaatagaaggcctcgattgggtgattttgtgaaaccaatcgatacacgacctgtagacattgatggcaatagaattaaagaaagtggcaatagcgcaaataaatatgatgatctagatatcaactctttttatgaagtatacaggatatttaatgttaagcatgtaatcattaaagataaactcggtcataaagttcaattagattcaagtcaataccaattagcaaagaaaatcactaaagaggaatatacgaattttaatgaaaaacttcatttattaaaacatattgataacaaccttaaaaggattagcaacttttccagctaaataaaagcactttgtcgagctgcagatagtagctcaactctttttaaaacttttgagaataaaaataaaatagttattgaccgatccgttttggtgatgtaagattaagttatcccaaagagagaaaggaggaaagagatgaaaaaggaattaaagatactgaaagtatctgtcgaagccttacatacctacaaaaatgatgtcaaaaggaattacgacattgacgaagaccaagcaagaagaaagttaaccaggaatgtgatgttggtaaaggaatttaaaccaagaggaattaaaagaggtcttttttctaaaacatactcatatggaaacttaaagatcacaattcgacatggaacagtaataaggattgaaaatgtaaaaggtgatcctgaaccttgggactttccaaaaaagagatacatagaattaaacaagctacttggtatcaaggattgtaagtttagtagcaagtctcattataggcattttaagaataaaaataaaatataatattaacggaggcgttatattgagcaaactttataatacatttgaatttatcggtaacctatttatttcaaacaataaagagaaattccatgaaattaaggaatatgacagcggatgggttaaggaaagattaagcttcgcagttcaagagtcaaaaacaaacagtgtttttgttgagattgaaggtggttactcaaaaagcaaacaaaataaagtgttttcattcagcaagggtacagaaaatgaaaaaggatcaagactcgaaattccatgggaagatcggttgaaagaagaaacagtaaacatggttgctgatttttctaagatcctaattaacttaaacgatgagtcaacaaaaaccaaattaaatgaattgaagtttaaaattagagggttggaaatgaaagactctcttactgaagaagaaaataaaactttatctactctcaagggagaatataaacaattaaacataaacggtgcagaattcattcatgaatacgatgctattcagtacttatcccaaaatctcgaaaagcataaagacaataaatttaaaattacaggtaatattgaatacaattcatggaatggacggaattttagaaagttcaaaatcaaaaccattgaaattgtaagtagtgatacaccatctcaactaagagccacaatggatgtatttttcacaagtgaatctttagatgaatcgtcatttgaagaagaaaaaaggtactttgttgatgcatatgtgcttagctatgataatcaggcaaaaaaagatcgattttttcctcagcaattagtcattaatgcacaaaaattggactttgaaaatgatttacatatgaaacgattaaatctcttgaaaaacttctttaaagttgaaaatgatgaagtatatcaccttcaatgggttgtgaatattttcaggggtgctgatgagattgagtttaccgaagaggaactcacggaaagtcaaaaggaaatgattgctttaggtttaaacacactagatgactttaaacctaaaggagggctattgggcgaaaatcgtgaagaaaatagacttttaaaacctattttaaaaaagattaatgattctaatgattttacagaaggtgctgcaacatctacatatgaaattgaagatcttacatatattccacaacagattcaaaattctacaccacccgtagaaaaagaagaacctaaagtgactgaagaagaaaaagataatgcatttgatgatttatttgcttgatttgaaaagacctaactgacatttatttaaaaacaataaggagatgtttatccatatggcaagaaaatttggtaaaaagaataaaattaaagttaatcctctcgattataacactggaattattggtgaatcggggatcggtaaaacaactttagctaaagaagtttgcgaagaattagtcggagcagatgggtatataatcttgaatattggtaaagaggatggcatcgatgccatcccaaatgcctcctatgaagatgttcctgattggacaacctttaatgaaattactaaagatattattaaaaacagaacaacagattatgcagatttaaaggttttagtatatgacacatttgatgagttaattaaaattacagaaccagaagttattcgactacataataaagctaatcctgaaaaaagagtgaatacaattaaagcagcgtttggtggtttccaggcaggagaagacaaagttattgagttaattcttgagaagatgtgggaacttaaaaaggtcggtattagcatgtttattttaggtcatacgaagaaaagaacaatgacagacgtagttacgggtttggaatacgacatgctgacaaccaatatgacacataaatacttcaatgcgattaaaaccaagctgcacgttttaggagtagcatctattaatcggtcgattgaaaagaaaacagtaaaacaaaaaattgggcctgacaaaacagtgggaacagttgttgatgaatcaagaatcatcacttttagagatgacaactttaatattgattcaaagtcaagattctccgatatcacaccatcaattccattagatccgaatgaatttattaaagcaattgaacaagctatccatgtggcttttgataaacaaaaaaataatacaaataacattgaagaagaaagaaaagaacaagagcaaattaaagaaattcaaattcacaacgaagttaacaactcatcttttattgataaagaagagaatgagaggttggccgaagagattaagacactattccctaatgcaactgccgaagctaagggtgaaatgaagaaaattatggatcaatttaatatgaaagattttaaaggtgtagacattgtaccaactacagcattcgagaagatagtcgaagcattatctaactgaaggaaaagagggggagtctcccccttatcaataggagagggtattcttggccagaagatgtgtatgtcaaatatgtaaagctaatggaactgttgatacttttttcagggtttctgatgataaggggaaaaataaatactactgtactaaggatgaatatgaaacctatatcaatgataaggtgaaacgaaaaaacctcttaaactacatagcgaaagatgtcttgaattatagagagggtcaagtcattcctccaatttttctaaaaaagatagctgaactaaaaagattttatgattatgaagtgatacaaatttgctttgagaagaaccaacaaacaattcaatattggttaactaataaagagttttacaacgagtatgggatgattagctatatttttaagattgttgaaagtaacatcaatgatgtttataaggaatggctgcatgaacaaaatcagagaatgattgaaaaaaatcataatcttgatattgcaattgtaaatcaaactaatatcgttgattccacatctttaaaacaaaacaattcaccaaaaaatataacagagtttctggatggggaggacgagtattgaacaacttagattcttatccaaaggaattagttgaaaacaggggacaaattgaaggaagctttatattttgtttatggaaaaaccctgatttgtatgaggattataaagaccacgtgagggcggatagagattttctaacagaagacgggaaattttattactctctaggtttagaactgagcaacatgaattataagagctttgatgatgcgagtgttttcagctacatagaaggtaaagaaacattaaaaaatggttttattcggcgaggtggaatgaaaaccattgatgaactcaagcacgtactaaacgatgaaaatgttgagacatactatgatgaactaattaaatttaacatgatactaaagcttcatgataagggattcaatgtttcgaacgagcttgataaattcaagaagatgacgagtcaacaattgtacagttactttgaatttcaattagataatgtttttctaggtcgcggttcaggagtgaaaattgaggatcttgatttgaatgaagagtttgtcgaatcaattgaaaacggggaagaaatgggattaagctattcagctgcatgtccattattgaattatcacacgcttggacttcataaatctaatgttcaaatttttgctggatttagtgggacagggaaaacaagtttttgtgtttcttcttatatcatgtcaattttagatcagggtgaaaaggtaacaattatcgccaatgaaatgaataaaagggcttggcaacatatttttatggcaacaattttaagtcataaacttggttattatggtttgccaagaaagaaacaaaaaatgggcaacctaaagcatgagcaaaaggaaatgttacaaaaggcaattgaatattatgagaagcattacaaggggcgtatcaaatttgccaagatatatgattacagcattaatgatgtaaagagaataatgagaagaatggcaaaacaaggcttcggttatatgctttacgatacatttaaagctgaagatgcggcttcaaccaatgtaacaggtgagctaattgaagcctcaaaacagttattgcaagttgcggaaaaagaggatatttgcatcatcattacaatgcagttggccatttatatggagaatacgagatatctaacagcgtcttgtttatcaaatgccaaagcagttaaggagattgtttcagagttagttctaacaagacctttatgggaggatgaattcccaggaggaaaattcgatgttaaaccctatagattcaaaaaagactcgtcgggaaaatttacaaacattaaagaagaaattcagttagacccaaataagaagtatagattattctttttgaataagacacggaatgacgaaggcgatacagtgttgttataccaatttgacggtgcatggaataaatggaatgagctcggttattgtactcctaaacatcagagaactacagagcggacatgattaccaagggacggtgaaatcatggacgtatatgatcttaagaatcacattattgaaaagccagagtacatagtacttattttagaacagacggggttttacaatgttgatgaacgcgggaatgagtacagatgtgcgagaaaaaaaggaagaaatccgacttcagtaaaagtaaataaaaccactttaggtgcaacctgtttttcaaccaacttaaaaggtgacttgataacacttgttcaaaataaattgggtttatcttttcccaaaacaatcaaaaggatatctgaaatagttgattataaaagtgaagaagaatataaaccacctgagttaccattcggaggtttttataagaatataagaagactaagtaatccaatggatttggatctagaaacgtattccgatgacattttagatcaatttgtatctgttccaaataagttgttttatgaggatggaatattacctttaactcaatctttgttccaggttggttacgatagtgtttccggaagaataacggtgccatggaaatctcttagtggtgaattgtgtggtgtaatggggcgtcttaataagaaggaagttaatgatgaggaaacaaaatggctgcctattatttcatttcccaagtccaaaacgctatacgggtttgttgaaaattacagttcaattagagaaaagagcattgttatgatcggggaatccgaaaaacattcaatggccttagcaagtaagggattgaatgttggagtttctttaggaggcagctttttaagtgaaattcaagcaaatcacataaaatcaatgtttccgaaaaagtcattagtcatgatggatgaaggattaggtgaagaacatagcgtagaaattgccaacagcctaaagtttgaaaatttctttgaaaatgaagttgggtacatatttgatcgtgaaaacaagtatctgcctaagggatcaaaaatggcaccagcagaccttgataaaagcactctacaccgtctaatcagagactgtacagtttggatatgaaaaggagatgattgattgaaagaaacattaaatgaattgagacaacaagggaaaaacatttattccttttcaaagcttggaacctttaataactgtgaatatgaatactacaatacatacgttttgaaaaagaaaggcatagataatatttacacccttatgggttctgaattacataacggaattgaacagatttataaaaatgaattagacattggtgaatttaaaaagggatttgaaaatagattaattgaattagagctgaatggagtcaactttccgagtgactcaatcggagacagctggaaagcagacattggtcatttcctaaacaattttaataaaattgacagcaaaatggttttagagaagctgcttgtatttgaaatatcagatgggatttatcttcaaggatatgtagatgcaatccttcccagtgaaaaaggaaaaccatacgttagtatttatgactggaagacatcaagtaagtttgccggcaagaaattaaatgaagcaggaagacagctattgatgtacaagcttgcattggagcaaacaactgacttaaaagtagataaaatactatggttcatggtgaaatacgtttatgtatgtacccaaggaaaaaccaaagtgaaaaagaaaatgtgtaacagaggtaagtgggtaaaggaaatacgaatgaaactagaaaaagagatgcgcactttggagtatgatgatttcgaaattgacctattgttagataacgcagtaaaagaaaatagcattgactgcttacctgccgagattagaaataagtattggcttgaagattgtttagttgaatacgaagttactgaagagaaaattaatgaactgaaagattatattactggtactgttaaaaagattgaaaataaagaccgtgaagatgaaacccaatgggaaccagtgaaaatagataaatacaattccttttattgcagtgtcttatgtggtcaccgaaaaacatgcaagttttataaggattttttaaataaatcatcaaataaatttaagaaaaaggataagaccgatttgtttgataacctattttcttagggggtaatgatgaggaagatattctatgactttgaagtttttaaacataactggatggttgtgctgatcgattatgatactaaaaagggtaaggttattgtagatgatgttgatgaactgaaacgattctataagatgtttaaagatgatatttggattggttacaactctagaatgtacgaccaatacattttaaagggaatcctgttaggaatgaatccttattatattagttcaagaattattaatgataatgtaaagggatttaatgttgttagagaaggttataagatcccactgaataactttgacataacaactggtttccacagcttaaagcagctagaaggctttatgggttcaaggattaaggagtcatcagtaccatttgatatcgcaagagcattaacagaaaaagaaattaaggaagttgttgagtactgtattcacgatgtgaaacaaacaattgaagtgtttgataataaaaaagaggaattcgaaagtcaattggctttaattgaagcctttgatttagaaatgtctatgtttacaaagacaaaagcccaattatctgcatttatcttgggggctgaaaagcaaggaaacaggggagatgagtttgaacttagatttcctaatacattaaaaattgaaaaatacaaacacattgttgattggtatagaaatcctgaaaatctagattataaaaaaaacttaaaggttgatgttgcaggtgtacctcatatttttgcctggggaggtttacatggggcattaccaaagtataaagatgaagggataattttatgttgtgatgttgcatctctatatccttcaatcatgattgaatatgattacatcagtcgtaacgtgaaaaaccctttgaaatatactgaaatcagagatacacggttagaattaaaacgcaaaaaagatcctaagcaggctccctacaagatcgtcctaaactcaacgtatggagcaatgaaagatcagtataatccactttatgacccgttaatggccaataacgtatgtttagccgggcagctgttgttattagatttgatcgagaaaattgaaccgtattgtaaactgattcagtcaaatactgatgggttgtttatgaaagttgagaaagaatctgatattgatttaattaaggaagtggcgaaggagtgggaaaccagaacacgattagatttagagtgggatgtttatgagaagatttatcagaaggatgtaaacaactatataatcattgataaagaccagaagtataaatctaaaggtgcttatgttaaaaaactaaacaacctggattatgacttaccaattgttaataaagctatgattgagtattttacaaaagatattccagttgaaaaaaccatcaatgaatgtgatcagttaagagaatttcaaaagatatcaaaggtttcaaacaaatatatgtacgctctctatggagaagaaaggctacctgaaaaagttttaagagtttttgcttctaatgatgaagatgctaaaggtgttttcaaggttaaaacagaagaacgaattgaaaaaatcggaaatactccaccgcgctgctttataaataatgataacgttattgatttaaaagttcctgattatcttgataaggaatattacatagagatagccaaaaaacgaataaatgattatttaggaatatcgaatagaaagaaaacaaagaaggagaagtgatatgcatcgccattaagagtaaaaataaaattaaaacacacattttcaagtctgtttatggtatgatgattttgattcccttaaccactttttcttacataagttatgagcaacatttacataaaacagagggaaatgaagactcaataaaagaatcattttataagaagcctagacagattaggataccatcaagtgagaatattgtcttacggctatttaaaaaagctcaaactaacaaagaacagcaattaaaaaggcatacagagaagattatctcagcaaaactcattaaacctaagcaaagtaaaaaaaggcacaggaagggaggtgagacggtaaagcataaactttttaagagtaaaaataaaattagtattaaagaaaaagaaaacaagccaccggccgcaaagaaaaccatccaggttaagctgagtgcttatattgcccactgccaagaaggatgcacaggaacaactagaacaggtgttgatgtcactcaatcaatctattacaaagggtatcgtgttattgcaaccgaccctagtgttattcccttgaattcaatagttgaagtaagcattggtgggaaaaagttcaaagcaattgcaattgatactggaggagcaattgttggaaataaagtggacttgcttgtagcaaccgagcgtgacgcaattaattttggcaagcaaaaggggacaatctcaattattagttaggaggcgattaattgccgaagttttggtcttatccagaagggttaaaagtcatcataaatgagaatgcaaagaacgcttgtcctcatcatgttggacgggaagggaaaattattgagctgctacactctgccacatatgattacgcagtcagtgatgaaacaggtgatattacattcttcaaggagcatgaattaaatccagctaaaggaggttgattgtatgtttaaaaagggagagaaggtgattgctggtttcacaggagagattggtgttgttgcacaagttgataaaggacatgagcaattagaagttgagtatccagacggctcatatagagtgattggcttcagcaatgtaagaagggtggaagataaatgacgatgattattttagaaggcactgactgctgctacaaatcaacagtagcagataagctaagcaaagaactcggatatccggtaataaaaggatccagctttgaattagctaagagcggtaatgagaagctgtttgaacactttagcaagctggctgatgaggacaatgtaattattgaccgatacatatattcaaatttagtttatgcgaagaagttcaaggattactcaatcttaacggaagagcaacaaagggtcatcgaggagaagattagggataaagccaaggtgatctacttacatgctgatccgaaagttattaagcagcgtttacttgaacgtggtgacgaatacataaatgatcgtgatattgagccggtattaggattatacagagaagtaatgagcgatgttgggttacatacatattcatgggatacagaacagtggtctagcgaagaaattgctaaaggcataatctttttaacggatggggtgatttatgaagaaagtaattgcaattgacatggatcaagttttagccgatttactaagtgattgggtagcctacattaacacctatgatgatccttttctaaaagaggaagatatactgtgctgggatattagcaaatattcaaatacccaaaacaatgtttacaggcatttggattacgaattattcagaaatctggatgttatagaaggaagtcagagagcagttaaggagctggcgaagaaatatgaagtatatgttgttactacagcaacaaaccatccagaatcccttaaagcaaagttagaatggctcacagagcattttccatatattccacatagtaatgttgtgctttgtggcaataaaaacataattaaagcagacatcatgattgatgacggagtgcataacttagaaacatttgatggaatgaagatactatttgatgcaccgcataacaggaatgacaatagatttattcgtgttatgaattgggaggagattgaacggaaattactttaaaatatcattatatttagagtgaaaataaagttaaaaggagtgaattaacactccttagtaaactaacgtgcttctactgtaattttataaatcacataattgtcgttaatgtcatacgcgtaaaccaatgctgtgcccaaagttgaatgagaggatacgacaccactggaactaatgcttataaggttgcttccagatacaatttcccatcgggtgtagccttttaatagagatacgttagaattcctcagcatgtgaaaatcaactgtaccaagcggatcacctagctgcttaacttgatcaattgatttgacaggggttaaagcagaagcctgtgatgtgaatgcagggagtgctagtgctgtaagcaatagagcagaaacaatcaatcctttgtaaaactttttcataagaattacctcctaggttttgattgtgattacatctccagtctagcatgttaaatatttgaaatgtgtgaagtgtttgtgaaactgtttaaaatatctcttttaaagagaaaggggagactgtaatgggttatagacattatatgtataaaatcagcaaggaacttgtaaacgaaataaaatcaatgaattacaatgaattgtccaaaaagttcggtgcaataggagaagaaggttatttctatataggtaacctgcctaaagaggaaatttgggagtttgggaagttgtattgggatgatacagccgaccgcatttattcaaagggacaccctctctttgaaagagaagaagttatgaatgaattatcggattatgttccatatattgttggtaaagaagggcttgaagaagctattgaaatttataaaaacaaagtcattgcaatgtacgagaacttgcttattgatgataaaaatggaactgcttcagtaaaacaagagcagcatattaagaacaacttatctgagtggactagaggatgggcgttaaatacggatattaatgattcatggctaacatcttcttggaaatatgaatacagtatttttgagctggtcagattattaaaaaccatagattttgagaaagagacaatattattttacggttggtgatctaaataaaagatcaattttatcgaaatgagggtgtgaaatggaagttagatggttagttatttttaatgattgtaaaaccggcagttctttgagtgagcttacatatagtaaggatggggaaggaaaccacctaagattagagtcaatggtgcctcgtacaggtgactatattgtaggaggagatctgtcatcagatataaatgataagaggtgctttattgtgaaaaatgtcttctggaatctagataggagagatatagaggtttatctagatgaggttgacaggactgtttttcctttatataaatcgctataaaatttgtcttttaaagagtaaaaataaaatataagaggtggagtctgtagtgaactacccagaaagcttaaaagaggaagccgaaaaaattaaagatgaagtaagaagcggcaaattagacgaggggaaaataaaagccattgctaagtctgcagttgagtttttaagatctcaagaaaagagtcatgctcattgtgcagaagttgctggagcgattgctgcaaacctagatgagttcttcaagtcttatctaaaagaagattaatacaacaagataacaagaaaggataaagggatgtttattgaaaaggtactatgttagatgtaaagatcacaaaggcgaaaacgcgtctttggtaattgaagcaatgtctacagaagaggctaaacggaaggcattagacatacataaggtaaagactgtttataacgtgagcattggggaaggtagggggacaaattgccttcagagaaaacattcgccgtacataaagaatgacaacgggaaagctataatcatattctcgtagaggaggtatcggataattagggatactgccagggatatcattaataatgacgttgatgagattgaggaaatattagataagctttgggtttatttagagaacaatttaaggccagaggataaccgtatatggaagaggtgtgattcggatattttggcagcaacagtaaagctaagaaatttaaaagaaactttttaagaataaaaataaaatagttgttgattgtttgagagaatgcgagtatattagaaatataagaatcgaggtgatgcattggagtgtgttaaatgcaaggatcacattggcgaaatcgtttattacataagaatagctgacaacaaagaatataaggaattcgcggtacataaagaatgcggagaagcaatcaagaaagaatgcattgaaaattgtaaagacatgaaattagaaaagacattggattacttgcagttactttaagagtaaaaataaaatattccttttatcgagaatggagagatgctaaatggataaattgaaagtttgtttacataaaaaaggtgctcatacgttagaaagaactgttaatggaggctggatattagattcaaaaccaattactcaggatcaagcaattaatgaactagttgaagcggttagtgatttaggatattggtgccaagtagcaaaggatgttttagataatgaagactttaatgcagttcaagaggcgtatgaataccatgagtaataatctagtccattataagaagggagaatgaaatgtcatatttggtgctgggactaatcttgttcggttcaatattcataggtaatggacttacaagtttagttgagaataaaaactttaaagaagccttgccattttatctcactgttttcttaatgggagcttgctcgctccttatcggatttattcttacagtgatatgaacaagatgaagggaaatagtgaaaggaaatataaatgatttcctgggaaagcgcagtatgcgacaaattggaacaaatgatgtctttaggtgataaacaaaaaaggagcatagagccatggaaacattagatgcaccaatttatgagattaagcaagaaagcaattggtataaaactgagaagaaacgaagagaagatattaacaaattctttgatgaattcgaagcaacatacggaattaagaatggtttttcgttctatcattccgagtatttcggagtacgcgcaggaacagaagcatatgacttctttaaagatgaagtggtgaaaaaccccacaaaagctggcttctatgcatttaaaaaacgttctaagtatttcacagacataaggtctatgctagagaaaatagaagaggcaaatcctttcaaaggccatgatgtgttcgggagaaataatataactgcaagccagtgggtaggtgatagatggttttttggcgtaagagatgagaaacgtgtagaaggtgaagaagctgtagctattgacttcaaagattatcttaaaattatcttggagaaattaggttaaaattcaatttttataaagaaaggagaaaaacatgagagacattacatccgaattcacattgagaggagtaaacagaaaaactctgaaactcctggcaactaagagtattgattatccagatacatgggtaaaggttcaaattggagatcaaatagcagaagttgaggcaaagcaactgttggtggcaataacggcatttaatgaaatgtgagaaggaagaaactaacatggagaagtgtagagcagtatttaaaggcaagaaaatagaaaagatttaccttttcagggcatatccatcgtgttttcatggcgtccatgcgaaacgaaagccaccagctattgaccacgagtatttagatatatctactgaaactttttatgaggatgaaattaattttgaagttaactgtggtgacactctttacataaatgaacttgatgaaaatgttcatatagaaaaaaaggtcaaaatgcttgatgggggatggatttacttcactgattatgtcattagcacagtcgagaataaggagagtaaaattcaagctgaaaaacaattaagggagtatttagacgaaagtaaagtaaaagaaaagcatgataatcagctaggaaataaaaggatatcattttggcaacatttgaaacatgcttttaagaaagagatgcaacagtaggaggtgaataagtgggacgacataaagcaacatttgaagggaaggtaattaagaaaagttggacattaggcttgtgtgatgcccttgtcccaatcgagcagcaatgtgagtatcagacattttttgaagggaacatcgacttagacccaattgaagtcggagggaaagtgtatatcccagggtttaacgaatacgtagtcgtaacagacaggcaacgcaacacaaaaaatgaatggacatatcagactgacaaggtcattaaaacaattgaggataaagagagccttgaaaaagcaattcaaaaacaagaaaaaatagagaaatggaatcagcaagttaaacaagactatgaacgctttaaagagcaagaaaagaaacgtaaaacttcctggtggaagaggctaatcactaaaaaagactaaaggagagatatttattgaataaggatacaaaagatatttggaacggtttctttatcggatcaggttctctgattgtagtggggttactcatttttgttgaagcagtgactatgtcactagttgtctattatggattgaatcatgtgttaaacccattgcttattgatacatacaacattcaaaatacccatatcactttacctcatgcatttgtgattggtgttttactcaacgtatttgtcaaaggtgtaaaacggtcagatcaggaaaaagatgagaacattttcaagaaagccggtaagtctttacttcattcagcttttgcattgattgttctgtatgtcagtacattgtttatttaacgaaggaggaatctgaatatgattaaatcgcagcaagttaaagtttttagagagacgttacattgtgatgaatgcgaagaagctccagagcttgtgttttcaaatatgatgctcacatcaaacccaccgaaatatccgtttcaatgcccattgtgcatgaaaaaagtttatatgaaaacaacctatccaaaggttagataccaatcagttgattgaagtctaaatgaaagttttattttattgaaaggatgaagaagaatgaaaatgagaaatgtaaaactgtacaaaacgactgaaaacgtttttcttccaaatgaaaaaacattggtagggacttttgatgattgtgaaatgtatgaaggagaaaggagtgtattcttagagattgcaaataaagatgatcttaaaccaagtgactctagtattcatatagaagatcctacgattttagaaatcacaacttgtcaaggcaaaacaaagactattaggacaaggaaaaggttaactgacatttcttctgatttaattaaaattgaattcacagttctgtaggtcgtaataaaaggatgattttagagagaaaaggaggaatagctatggcttatgatgagatcaatgggaaattaattaatcctaaagttagcgatgtaattaaagcgctacaagaccaacttgattttaacggagatacaccaattcaattcagaattgatggtgaagaaacaagcaatgaaattcaattagatccatataaaaatgttcttgtgtttcatttagatgaagtttaaggaggaaagctacaatagacacatttgttttatcggttgtcaggatagacattataaaggcggtttatatatggttattggagaagcagttcacactgaaacagaagaaaagttggttacatatgaaggccaagacggtgttctttggaaaagtgattattgatgggaaagagatcaagagattcacaaaagtaaaataaaaggagaattggctatggggattaaagcagcagtttttgaaataaaagcaacttgttacgctcatgagggatttaataacgaaagtgaatctgttcaaggggctgcgttagaacagctaggaaaggatatcgtagataatttactcgaaaacggtgttgatgatgtaaaaatcaaaggcgattacgttgaggaattgggagttgagaagcccgttatgaagtacttcgaagtgagcgatccctattatgcgttaattaaagcttactcaaaagaaaaggcaatgaagttatatacaaaagaagttgctgatgatgacggggaattaagtgatgagatgactgaagttggacaagtttatgcggcaatacgacaaggaagggttccgggagaaggtgaagagcttatgccatttaagcaggttcttgaagagatttctaatgatgaagaaatggtattactaatcgagggcagtttactttaacggataaaaatacaaggaggtgaattcatctgggaataagtcaaagacagggcaaatatatcatggaatcgattaatgaaacaaattcaattgcagaaataattggtcatgataaagctatcagtgaagtgttgcttctattaagggaaagagtgttgtttcttcaaagtcgatatgattttgaagaagtggaaataagattaaatgagctcatgaagctgtatgaaagtatcaataaacttcaaagaccacgaaaggatgatgaaaatgaataaaaaatacggactttattgcatgggaacacttgttaacacttatgatgacgctattgaggctcataatgatgctgtgtatgctcaagaagaaagtggagtgccgcatgaagtaagagaaatcagaaaaggagagtagataggatggaatacactaagtatggaaatcttgtagaaggctatataacattcaatctttattttgagacatttgaatacaaagaagatagcttattagaacaagtaaaattcaccacagttaaagagttattcaacatgatgcagccagactatgttgaagaactaaagcaagaaaacggtgcagatcaggttgacgttcatgatatcacgtttagcgctaaagaagatgacactgaggctttcatcacaatgtatgacaactcaggaaactatcgaatctcaacaaatcttgatgtaagtggcttggatagcgagtacaagcaaacattaaaaagcattaaaggtattatagataagaaactttgagagtaaagtaaaggatgatgaaaatgaatattagagagtttattgctgagcagagaaaagacgaaaagttcttgggtttgagatcaaaattaagggaactaattgaacacagaagacttgaacttgttgaaatgcttggatataaaatcgatagtttgaatcaagagcaacttatagaattcaaagaaaaattcagtgaattaactgcatttaaagaaaaggtaggtaatgatcctttcagcattagtctggatgaacttggcgaacttctatgtttccaaaaaaaataaggaaggtagatacaaaactctggagtatgttttgagtaaaacgattgatccatacattgataaaccaaaacaggctacagttatttctagataaaatcacagtttcaaaggaaggggaagcaaaatgagtgcagcaagaaagtggagagatttgagaagcaaattaattggatataaggtctacggtaagttcagcgatgttgttattgaccatattctaaatgatatggataagttagacgtaagacatgacaaagataaaaacaaaaaataaagaaaagggagttgtggaatgggagctgctaaacagttatacgttaagcgcagtcactttgtaaccttggatgaagcaaaagaaaatacgcaagtacatatgaagaatggtggttcatacactgctttaaaaggagagctgattgcgactaatcttgaaggggatcaaatggttatcacacaagagcagaaggataactacattccagtaccaatgacagagttatcagattatgaagctcaaatggccaaaggctatgctgaaatgggagacattaatttagaaatgtctgaagcttttcatcatgctgaaaatgaagcagaaacaaccaccaacagtttggttaacggagaatataaagaatattgattattacatatgaaagcaagacaggcaatgtgaaaaggtttgctcaagctttacaaagggagttaaacttcgatgtcattgaaattacagatgacttaatcattgaagaagaatttatacatattacatatacgataggctttggggaagtacctgaaaggactttaaactttattattaagaataaaaataaaataaaaggagttgttgtgagtggtaacaaggtttggggtgataactatggtttagctggggacaagctctcagcaatgttccacgtaccattgttattaaagtttgaactaagcggaacaaaacaagatttgcagaagattaatcgggaggtacaacttattgacaaacacaataccaaagtggattaagctcaataatgagatcatgattcagaaagacggtaagtttcaatttgagaaggataaggaggcagtacacagctactttgttgattacattaatcagaacacagtctttttccatgacttaaaagagaaactggattatctgactaaaaatgattattacgaagaagaattcttaagcgaatacacatttgagcagattaaatcgatttttaagattgcttacagttacaaattcagattcccttctttcatgagtgcctttaagttctacaatgactatgcattgaagacaaacgacaaaacaaagatattggagagatatgaggatcgtgtctcaattgtagctttatattgtgcagatggtgattatgaaaaggctattgaggaagtacacgccatgatgaaacaagagtatcagccggcaacgcctactttccttaatgcaggacgtaagcgaagaggtgaaatggtaagttgcttcctacttgaagtgggagacagtttgaatgacatctctcgtgcaattgacatttcaatgcagctgtctaaattaggcggtggtgtagcattaaacctaagcaaattacgagccaagggtgaagcgattaaagacgtagagaatgcaactaaaggtgtcgtaggtgttatgaagctattggataatgcttttagatatgcagatcagatgggacaaagacaagggtctggagcagcttatctaagcgtattccacccagacatcacagacgtccttgataccaaaaaaatctcagcagatgaagatgtccgagttaaaacactgtctattggtgtagttctccctgataaatttattgaattggcaagagaagataaggatttttacatgttctatcctcactcagtctacaaagaatatgggaagtatcttgatgagatggaaatcaataaaatgtatgatgagcttgttgaaaaccctaaagttagaaaagcaaagggaaatgctcgaaaactgttagagcaattggccattctaagaagcgaatcaggatatccgtatatcatgtttgctgacaatgtaaataaagtgcatccaaatgaacatatttcaaaagtgaagttttctaatttgtgcgttactggagaaacacttcttttaactgagaatggatatgaaaaagcagctgatctttacaaaaagcagaatgagcttaaagtggtcattgataatagaacaaaagattttgcagttggcagcaaaggtacttcaatagtagatgcaattccaatgcaattgactaaaaaagatgcggaaatatttaaagtcaaaacgaagcaaggatatgaaataaggacaactgagtggcacaaattctatgtgaaaagggacggtgaaattcaaaagctccaattgaatcagctaaaaacgggcgataaattattagttcaatcaggtgagggagcatacggcgacattcatgagccagatcttgcttacatcatgggcattatagctggggatggaaccattactgaaaaaactgccaagatttatttatacgataacaaaaaagttcttgagcagaaagttactgatgcagttcaccgtattattcaaaaacacaagctcgatcgtgcttataaacacaatacatcactggctccaacatttaatatggctaatccagaaaaacaagatttactctacatgaatagtacagtcttatttgacatcttgaagaagttcggtatggacaaagaaactaaaacaagagtcccagaattcatttttcaagctaataaggaaacgcaagcagcttatttatcaggtttattccagactgatgggtgtgtaaatgcaaatcataaagccaaagcattaacaattgagttaacatccattcactatgagagccttcaggacgttcagaagctattactaaacatgggtgtttatacaacgatctattctaacaataagcgttcacaagaactccttcctgacgggaaaggtggttctaagctgtacaatgtaaagccaactcacaaaatcagtattcaagatagaaactcaagagagttgtttatgagcattgttgaaatgaaagaatacgatatttataaattcaatttgctaactgagacattgcaaccttcttcaagaaagccaaagcatgattttacggctgaaattattagtattgaagaagatggtgttgaggatgtttatgatacaacacaagaagactatcactctctgattttcaatgggattgttactggcaactgttcagaggtgctccaagcatcacaagtctcagtttatacagattacgatcaggaagacgaaattggtttagatatctcatgtaatcttggatccatgaacattgtaaacgtaatgagcaatcaatcaattgcttccacggttagaatagcaattgactcactaacgactgttacaaggaaaacaaacattgtaaatgccccagctgttgcgagagcaaatacactaatgcgatcaattggtcttgggcagatgaatctacatggttttttagctcaaaataaaattgcttatgaaagtgaagaagctaaggactttgcaaatacatactttatgatggttaacttctactccctgcaacgttcaatggaaattgcaaaagaaacaggggagacgtactacaagtttcacggatcaacttacaaatcaggcgagtattttgataagtacgtgacaattgattatagccctaaatatgaaaaggttaaaagcctgtttggagatcaacatattcctaacattgaagattggatgaagcttaaagaggatgttatgaaatatgggttgtatcattcgtataggcaagctgttgcacctactggaagcatctcatatgttcaatcatctacagccggtgtaatgccgattatggagagaatcgaggaacgtacatacggaaacagtaagacatattatccaatgccaggtttatcggctcagaattggttcttttataaggaagcatacgacatggatatgtttaaggtagttgatcttattgccactattcagcagcacgtcgatcaagggatttcatttacgctgttcttgaaagatacgatgacaacgcgcgatctgaaccggattgatttatacgcgcatcatcgtggcattaaaacgttgtattatgcgcggacgaaagataccggccaggattcgtgcttgagttgcgtagtttaaacgaaggggaggcggagtcgtgaagttagaaatcggtcaagagtgggtcagtgaaaagcacccacatgaaaactttaggatctacggaggagtagtggatacttgtgcagactcatttaaggacgaaagcataacattcgatgagcagccggaatgggctaaaattttcttctgggagcgggcggattatgcgagtttcgataaatacgtcgaatcaaagctaggaaggaatcgagatagtacgtatcctttcgctagatgtggagagacgaagaagtccggattagtagcaaaaatcaaaaaattcaatatggtcgttaaagagaaggaggatgaataattgacgcaatatacagcagcaaactggtcaaagcatgaagatgatttcacccaaatgttttacaaccaaaacgtaaagcagttttggcttccggaagagatcgcattaaacggcgatcttcttacttggaagtatttgggtaaaaatgagcaggatacgtacatgaaggtgctcgccggcctgacactgcttgatacagagcaggggaacacgggcatgccgattgtggccgagcacgtcgagggccatcagcgaaaagcggttcttaatttcatggcgatgatggaaaacgcggtgcacgcaaaatcttacagcaacatctttcttacattagctccaacagagcagatcaacgaagtgtttgaatgggttaaaaacaataaatttcttcaaaagaaagcaagaacaattgtttcaatttatgaagcagttcagaaaaacgatgatatttccttattcaaagcaatggtagcgtccgtgtttttggagagtttcttgttttactcagggttttattatccactttacttttatggacaagggaagctcatgcagagcggggaaattgtaaatttaattatccgtgacgaggcgatacacggcgtttatgtcggattgttagctcaagagatatataagaaacaaactcttcagatgcaaaaagaattgtttgaatgggctttaagcttgttgcaggagctttatgaaaatgaattggagtatacagaagatgtttatgatcaggttggtttagctccagatgtaaagaaattcatcagatacaacgcaaataaagcattaaacaatctgggctttgatcattggtttgaagaagaggatgttaatccaatcgttattaatggattgagcacaaagactaaatcacatgacttcttttcaatgaaaggcgttggctataaaaaagcaacggttgaaccattaaaggattctgatttcattttcgatagcaaaggagttatttcatgagactgattaaattagaacaaccgaattgcaatccttgcaaaatggtatccaattatttaaacgaagcaggagtcgaatatgagacatttgatgtaacacagaagccagaagtggcagcgcaatttgaggtaatgagtgtaccggtgactatactgctgaatgagcaagaagaagtaaagcgtagtgttggatttaagcctgaagaacttgatgaactactaaagggattacaataaaagataatttccttaggggagggctaaccatattcggttggaatattaacgagatttcatggtggaagtacatactgcttttaatttttttaattactgtaatacctttgttgataatggattggataaccttctgtaagattaagcatattgactggattattcaacgatattcatgttgggcggcctatttaatttttggatagatttttcacataataaaacaaaaggagaatgttaaatggggaaaatggatgaagtaattgttgtagcacctagagataaagtatttgataatgaagaactagtctttcaaggaattgaatctgatctaggcaaggttgatcaaataatcgaaaatctcgctgaaagcatgatcactatgaataggggagatgctgagagggatcaaagctgtaagcaaccaattccctatgccattttacaaaaaggagaccgagtatttgcatacgagcggttaagaaaaagcggggaaaagaggcttcatgatcaattatcaattggtgttggcgggcacatgaatttaactgaagcaacaaatttttgggaagctattgatgagaacttaaggagagagctttcagaagaggtgtttatctcaacttccaatttaaatttagaagttgtggggttgataaacgatgacttaaatgaagtggggaaagttcatttaggcataatgattattgttaaactgcctgaaaatgcagaggtatctgtaagagaaacagatcaattaaaaggcttttggttaaataaacaagattttgataatccattagtatttaatcgtttagaatcttggtctaaatacgtggcagatattatttattagtttaaacccctggctttgatcatgatgtttgtcagtggagggtctcagccagggtacaacttaaaatactcaaaaaactcaacaattatgcctacaaaggagatgctggatgaaaaaaagattacgcaaaaaggcgtggatgacagggaatataaaacagggcgaattcatgtttaatgtaattgataaggtaaatgcagatggacatgtatattatccaaaaggacactatcatgtagacaggaaagggaatatgtacaagttcaaaatttagaaacaagcgaaattgtgatgactaaagttgataaagatcttagggataccaaagggtgtcgattgaacgaacatctctataaaagaagacttttatttaaaataaagaggaggaaacagaccataaacaataacagtcataaagatttgcaagcaaagtatgatgatatgctcttcagaaacggactttgtttggggtttattcaaaaacaagggcttgcagatgtgtttttggagcatatgaaacaagttgcagcttatgaagaagaccaaaggtatagagttgcagcagttaattttttgagtttattagaatcaaattaaaacaaaaaggagatttgaaaatgaaaatttcaattaaaacaaggctaaatcctactgatcaatataaggttgacgactttattaatgcatttaagaacttgccgccagaaataagaattcagctttctatggacaacgggaacagttggctgttagaacaagtgtcagtgaaaacagaaagaatccttcttgattgtttacaagaagaaattaaaaatattgataatcaccctctttattctcatgccacttcattagggcaaactgtattccacaatactcatgaaattgtcgatgttgtcaaagagtatgtgaagaaaaatggataaacatatagagaaaatacaagcccatctaaaagaaatagaaaattttaaacaaggcctccaattattcagtgaagatgaagaagaatacataagcttattagctaagattcaacatcagtttgatttaatttcagacgaatcaatggaagggtttaaagaattaactttacatataagaaatacaggtcagaaaagaatccaacggagaattgatcagttacctcacacaatcaaagaaagtgtaagtgaagaaattaaagacatgaagagagccggcgagctttttgattgatatttaaattttaaacatggctatataaacagtgacaagtatcgattgggtgtgaacttaaatacaatacattgaaaactgtgaagaactggaggttttaatgtgtttagacaatatccaatatggtacacaccgtcgctgcatactttgaattacttgccacaatttacaccatacattgcccactttaatagtgctgaacgatgttttcaacgatgtatgtaccaaacgcatggcaatgttgaatggtgccatagaaactgctacgacccgatctatcaataaatttaaccagagcagttggatttaattcctctgctctaaaaaataaaatagggggatgtattataattacatactttacgttaatacttgcagcatacttatttgcactaaacattaatgaaattagattaattactcgaggggaacagaacgtatacgctaaagtcacacatttgctttctaactcaccatataaagaactgaagaagaataagaacttagtgtatgtcatgacattgttcaaggggatttcgttcattatccccttggctactattggactgattacgcatggtaacttgctaatgttagcttgaacagcttttgctttaatatataccggtttaacaatgtttaaaattcttgatgttttggacggtgactcaaacaataaacaaaacaagttcgtgtacatgctttttgtttgcggtaatattgtcttcgtggttaactttattatcagttggtttagataaaggagaatagaattatgactcagtttgatatgcagtacaacacaatcataaatgacataattaataatggggcatctgacgaagaattcgatgtcagaaccaagtgggatacagatggaacaccagcacatacattaagtgtaatcagtaagcaaatgcgctttgataattccgaagtaccgattttaacgactaaaaaagttgcttggaaaacggcaatcagagaattactttggatatggcagcttaaatcaaatgatgttgacgaattaaacaagatgggcgtacatatctgggatcaatggaaacaagaagacggtacaatcggcaaagcatatggatatcagcttggtaagaagaacagaatgctaaacggtgaaaaggttgaccaggttgattatcttcttcatcagttgaaaaataatccatcatcacgcagacatattacaacgctttggaatcctgatgaattagactcaatggcattgactccctgtgtctatggtactcaatggcttgtaaaaggcgggaagttgcatttagaagttttctgtcgcagtaatgatctcgcactcgggaatccgtttaatgtgttccagtacaatgtattgcagcgtatgattgctcaagttactggctatgagctaggtgagtatatcttcaatatcggagactgtcatgtatatactcgtcatatagacaatttaaagattcaaatggacagagagcagtatgaagcacctgagttatggattaatccagatgtaaaagatttttatgatttcacaattgatgatttcaaattggttaattataagcatggagacaagctttactttgaggtagcagtataatgctatctcttattgcttgctgcgataaatcaatggccattgggtatgaaaataatttgctttaccatattcctgaagacatgaaacgttttaaagaactcactacaggaaagttgtgtattcaggggagacttacatacgcttcaatcgtaaacattacaagaaagccacttcagaaccgaaagaatatcatattgactaaaaataaggatttcaagcctgatcactcttcatttgtttatcattcgattgatgatgtattaaagcttataagaggacaattggataaagatgaagaagtaatggtaattggaggaggtgctatatacgaggcattcttaccacatgctgataaggtttatttgacgattgttgattcagttgctgagaaggcagattcatattttcccaggttaaatgatgactggagagtaattgaaaaggatcacaggaaagcagacaacaataccacatttaattattcatttgtgacttactcaaaataattttagaataaaaataaaatagttatagactttttagaagttgaatgataagataaagacaagttaaaagcttgtcttttttttacatacttttagaataaaaataaaataataaataggagtggcgatatgaaaactgcaacagattatcttgtttccatttccaaacctcttgttgcaattgaggagactaaacaacgacttcaaaatgaaattgataacctttataaagagctagggaaagttgataaagagctcaatgaattttatcacaagctagaagaggacaaatttaatgcttcagagggatatcacctttcgttgaaaggtcaaaagatattgagaaagcgaagaagcttaaaacaagagctccaattactgaacacgcttttcggaagtttaaacaataatggatggactcttgaatcactgaagattgcagaatataaaattagcaaaaagaaaaacaagcatttacagtatgaatcggtttaaaaacaagcctacataattaaataaaaaagagagggaagccctctcaatgtattagtaattataatcccaataaacatcaacattaacttttacttgagctacactgtcattgttatgtgctcggacatacaattgttttcctgaaataagtgatgtgtttacgctaaatactttgtaaaattgttcactaatataatttccgccactcggtgtaacagaagccagcacagtgccatctgacttcattaattcataagtcacatttgcacttctacttcctgtccctgttgaccattgtttccccatgatggaaatcttggttacgttgtttggtgtaaagctagtgactactgttgcgtaagatgcagggcctgaagtagatctacctatgttgacttcaccaacaccatttttaacgtgagtatcagtcccaagagcatgaaaactaccggtgtttgttaagacctcaagattattttgaggggcggcaaccggctcacttttagcagtagcattcgctgacgcagctacaccagtaagaccaatagttgaaactaataaagcaattgctgttttcttcattaaaagcatctcccttggtttaggtatgtaatacaactatattataacaattaattttgaaataaatggagaatgttgtgaatatatggtgaattttctgaatggagtgtgaatttcttcggtgagaactttaaggaggtgatatattgcaacaaaaagagcaagaattgctgtcaaagaaagaacagcttgaaattgatgttttagaaaaggaagcagctttactccggctagaagtggaacaagaagattccaatctccacaaaattggggagatcggtgtacttaaagaatttcttttatacataaagaaatacagatcaatgtttactgtgcagcaagcagaagaatttagaaatatggatgaccgaatgaaagaaatcatcaaagtccaggttggacaagtaatggttgatgaagaagctttagagggatttattgaggaaattgagaatcaaattaattgaaagtgggagatgaggaatgaatgaaaaattaacgaaagatcaactcgaagaaatccgtcaacgtatggaagcgacaaccaaaggattttggcatgcaaacattcaccatgaatggccagggaacgaaaatcttcgttattggatagttactcttgaggatggtttagcagctgcagtaactaaagaagacgcggacttcatcgcaaacgctcggcaagacattcctaggcttctcgattatataactgagcttgaaaggaaacttcagaaaaaagaatatgaacttacagagtgtaatcgtgtctatttagagctgttgagtaaacaagagttcaaaacaactgaaatctaagtaaaatctgtattttaaagagaaggtgatgcagtgaaagagtcgttgaagaatgattttcaagagtttatgagtattgcaaaaagctttcttgctgtttctggagcagtcttttggttattgataatttcactcgtttttgctgggggctattaaaatgaatcaatcatataaagttagtctagaaaaattaccaattgaaagcttagagagactgaaaacagacatacaaaatagaattaatgatggattgcgtaccgataacaatgcatacataaaagaccaaagaagaaaacttcaaatcgttttaaacgagctggttagacgaagtacatttgttcactaaaggaggtgaatacaatgccagtagtactttatggatttggaagaggagcataaaaagagaggggagtaatcccctcatacattaatgaaattggccattcatgctttgttgggctaggcgaactaaacgttttgtgatttctccacctactgaaccgtttgctcggctagttgtctcaggccctaagttcacaccgaactcagaagcaatttcatacttcatttgttcaagggcaccagcagcttgaggcacaagtaattcattgctgttgtttgatctgttttgttgagccatatgatcatctcctaaagttgtatgtaaacaagcttgttcaattgtattgtgtggagatgttttgtaaatatacacattaatttaaagtgaggggatttaaatgtcaattggtcatggagcatgaattaacacgtacttaaacaaagaagggggataaaatgaaaatcgattatgtttcagatctgcatattaatcactggataccttgggacaatgaccaaattaaatgggaaaggcgaacaagggagattattagaaggctgatatcgaatggaaatggagaggtattaatcattgccggtgattttactgagtggaatcaacagacactgtgggtacttgatgaagtagcaaagcagtatgaaaaggtttacttcacatatggtaatcatgatctttatttactcagtaaaaatcagcaacgaaaatattccgattcattgggaagggtgaatgatttaattcagaaggctacagacatcaataatgtcactccattaataaagtctacggatacatacaaagggaaagtctttgcaggagatgttatgtggtatcttccaaaaggaaatgaaggatgggatttcttcaaaggtgtctctaatgattcaaactatatcagccttaatggatacagcaaagaagatggggtacgagcaatgtggaaagaatcaatgggctggtatgacactcttgaaaactctcacattgatgtatttgtctcacatgttccacctgttcacaatccttattctccgtttgagcctaacagctgctatatggttgatgtcccgttcattaacgcaaaacattgggtttgtggtcatgatcatttacaagctgagtttgacaatgatggaacgagctttcacatgaactgcattggatatccatatgactatgatatgtatcctagagtaaatgagataccaggtaagcaagttgatacgtataaaacgtttgagctgaagacatttgaaatcaaatgaaattctaattttatacagaagggagaaagtaaaatgtctaatgtgaaaattaaatatgttacagactgtcatgacaaagagtttacattaaataaaaaatatgattttcgtataaccgatgatggtattgaaatcattgatgatttaggtgaagaacatatcattgcaactaaagacaatgaatatggggcttatgaacacgatgaatttttcagatcaagatttgaatttgttgatactgaataaaatgttgatttcatttagaagggataagttcaatgaaagagattgaatttgatgaagttaagaaatttgttgaagtaatgtctagagaatttagatcaacaaagatgatgaaaattaaaattagctatgctgaatggttagttgatgaagttgaacgattaaggggttagtcaaaagtgagcaatagtttagagagaaagattaatattcatttcagtaatggctcacatatcgagtctaaacaactttctaataaactaagggggtacaatagcaatttcttatgggagcaaatgcaagagagtatcacaaaggaacttaaatggtggggagtcactctaactggaaatcagaaaactgtaaaagctttaagtgagctaatgaccattaacaaaacattgtttgagaacctttataaggtgcaatcagacaccatagaagagcttgcaaacaaattatatgaacaggttcctgagtatgagaagaagtttttgaagtttgtcaatgaacagatacctaatctgaggatgtgcctacagttcgagctaccttataatcctcaactaatatccagcatagaatatgaaatttacatatccggtgccgaaattgattgcgaatacccacatgatgctagggattgcattattactttctttcaacggataccagaaataatcggttcatacaaggaggaattagatgaagaatacagagtttaaggtaacaagtttattagaggagtataaacgaagagatgaggaacgtagggaattcatcattcatgaaggctacagagctatcgaagagatcattaaagaagtgaaccaaagaggatcactaaatgaagcagatatttattatggaacacctaaaccacagttaagcttctcggacgtcgaattaggctacatgcttacttctatgatggaatatgctacaaatcatgttggaaatccagttgatgaggaatgtgaacttgaaaataagctggcttactttgagcataaggacgaaattgttcaagtttttgaagtatatggacaaggtactgacagctggtttttgaaaccaagtgacgataccgtttataaattgaataacacagcttacggagtgtatttaaaccagttcgatgatttcattaattacactaaaaataaagacaatgagagtaaaaaggtttcttatggtaccacgatcttaaatgacattgccggcggatatacagttggaagaggttctaagtagatgatcgttacagcttggattttgtttgttgcatttgggcttgttttgttagcaagaatggattccgaagggaatcttaaatttgcagtgtatattggtgtaattaaatttgtttcagttttcattgttgccattgcagcaggagtgatttggggagggttatttcaatgataaagaggattatgagttttaagtttgacgactggagacatattttctacttattaaaaagtgtagcgaagaatttctttaaaggtgattttcatgaagcgagcgatgcactttattggatacgggtacacttgtcttttgaatcaaataaggtgaagtgaacattagataaaatcggtcatttatttagagtaaaaataaaattagatgattagaggtggagagtaataactgagtacattaagaacattcaaatactgttcaacaaaatggaaagacaaatgggtacggtgaaagaagctctcgagaacaaagaatacgaaagagcccaccgtaacctaatcaacctttcggataataatgaagaattgatgcaggaaatcagatgggctcggaaagggattaagatttaacttttcttctttcttcgtggttccattcgtacagctcttcaattgagcaaccaatggcatcagcaaaagtcatgccagtagctaagttcatatttgctttagctccacttatataatcgtggatacgttgtctggggtatcctgtacgtttgaaaaggtcatcaactgtgaggtcatattcaaacattaattcatttaaacgagggcgcaggggtgtccattgcttcatttcgaacacttctttcaatattaattaacataaaacagtgtagcaaaggtttattctaatttcaattttagtttcaatattttaggagagtgattgattgggaggtacaaaccaaggcaaggtttttgaagcaaatatagaaaaatcagctgcaggtcaaaagctgttcttctatagaattaaagatgttaatccagtgtttttaaaaaggggagctgcagtatcaaaaaacaaatatgattgcttcttgcactttaaggggtacttattcccattagagcttaaatcaacaaaggataagtctattgcctttcaagagaagattataaagccgcagcagataaaacacttaaaagaggctacgcaatatccaaacgtaatccctgggtttctatttcaatttagagagccggaaaataaagtttatttcgtacatattaatgatttccttacatataagaacatagctgaaaaacaattgaaacatacatataagaataaagtaaacaaagccagcattccaattgcaatttgtgaagagatcggcacagaagtccgttcgatgaagaaaaaagttaactatacatattacttgaataagctttgcgatgatttgattaaaaaagaacagcagagtgtgagcgctgtatgagtgaattcgttaaatcatcttcaaagcaatcgtttgaaatagaaaaatatcatataacgattgaaagcataaatcaaccatcagctgaagcaattaagaaagtcaacctaaaagtgaatgaagtaatgtctaatttattagcaaaagaaaagagccattaagccggctctttttttgttgtacttaaactataatacttgtgacgattatcgggatgaccttaatgccggtcgcgatgaatcatattgccggcggggaaggcagcaaggatttcggtgatccggctaaccttgccctcggatttacggtgcttgtcatcatcgtgctgctttatcggtttacaaaaggatttttgaaatccatttcaattttaatcggcattgtcatcgggacggccatcgcatattttatgggaaaagtgcaatttgacaatgtggcgaatgctgacgccattcaaatgattaaaccgttttatttcgggacgccgacatttcatgcggcaccgattattacgatgtcaatcgttgccattgtcagccttgttgaatcaaccggcgtctatttcgctctcggtgacctgacaaacaggcgcctgtctgaacgtgatttagcaaaaggctaccgcgcggaaggtctggcggtgttcatcagcggcattttcaatgcttttccgtatacggcctattcccaaaacgtcggcctcgtgcagctgacggggattaagaaaaacgcggtcatcggtgtcacgggcgcacttttaatgctattcggcctttttccgaaaatcgcagccttcacgaccatcatcccgtcttcagtactgggaggcgcgatggtggccatgttcggcatggtcatttcctacggcattaaaatgctcagtcaaattgactttaaaaagcaggaaaatcttctgatcgtcgcgtgttcggtcggattgggactcggtgtaactgtcgttcccgatatgtttaagcacctgccgtcttacttaaatctgctgaccacaaacggaatcgtcgccggaagctttaccgccgtccttttgaatattgtttataatatgattcctaaaacgaaaaaaacccttgatgtgacaagggttcaagagggttagttatccgtttttcttaaaaaaataacattttaataacatttctttatgaaatcccgagatcgaggatgcttccgaaagtttgctgaactttttgtgaggcatcctctttttttattagtttcattgtttgaaaagaaataaattgagtgatgcggcatccgccttatttcgccgaacaaccgtcccgaactatatgtacgtgaacatatgactgaatgtaagaaaaaaaggagaatgggggatcatatcataaacgaatatcattgttcggacggtgatgacacgaaacttggtttagacatggaatgaaatgcctgatgccgaagtgcaactgcagaatgggcgctgagggggagtgtcttgtgcacggatccttacaaaagagagtgaaaagaaggggaagccccttcttttaattaatccatccttcaaaagttgcgcgatagaacccttcgattatctctactttcttaaggtaataagtaacaccatttttaacagttgtatttgggatatcccatctatgaaggtaatccattgtaaaagaatctttgatcgcttgtgtcgaaatttttgtttcagttgagtcgctatttgtattgccagggctggatgcaaaagcaggggaagcggaaacgagtaaagcgagagacaaggcagaaccagttaaaacttttttcaatttcattttaaacactcctttgttttttaatacaattgtattattacacaaaatacaataataaccaagaggttttttgttaatattttgtgggcgcagcgtgaatttttttaggggagtggatggcaaaaggggcaatcctttcatccgctgttgcagcttatttcaggatactgatatgtatatagagaaaaagagttgattattgctggcctctggtgagctgcagcctttgagtgagtgtttgatttagctattccagcgcttttccaacgggaaaggtgtgatatgaaatttaaaactgaaacaattgtacaaaagtaaaaactttatttaaaatgttataaatactaattttcaatataggaggttatctggtggcagaaaagaaaaaagctttaatcattgtggatgtacaaaaagctttcgattataaaaaatggggagaacgaaataacgtaaaagcggaagaaaacattagtaaaatactgaaattatggagagaaaaaggatggacagtcatatacatacaacatatttctgataaacctggttctttattttatccaaaaaatgagggggttgctataaaggagatcgttaaacctatggataaagaggtcattataaccaagaaagtaaacagcagctttatcgggactaatctagaagagattttaaaatcaaatgatataacaactgtcgtaataactggtttgactacgccccattgtgtttcaacaactacaagaatgagcggtaatttagggtttgatacctacctcatttcagatgcaacagcagccttcggaatgaaagaccaaaatgatacatattatgatgccgagactattcacaatatatctctggctacattgcatgacgaatttgccacaatattaacgactgatcaattaatcaatgattttataaaaacaaactgattaacattatagctaaggccggcggtgggtatagcggctgaaaagcatattcaggcgcatacaaggatctcgtctgaaaaaaggcatctgcttcagatgtttttttgtttcttgaaaaacgggctggtaaaaaatgatcggcgcggttaacggtctgattcggctttggttttgaataacaaaaggttttactaatcagcgaattattcaagattttttggcttgtgctgagtctgtgtcttttgatttcctcgaatagattggcttgatcatctttttgtggctgaggctctttgttaagacattttgggtcgatcacatttttaaaatctttgatggttaaaggcttacagtcatcttttaattcgtagcctaattgtccattagcttctaaagtggcatatttaattgaaatgccaagaagccttaaacgcatttcgagttgatctgctgtcagtctcagcttctttaagttttgtatattagttggccgtcttctatatcgaatttagattttccggttaaaaaaaatcaatccagtttacttttacttgaaaccattccatcaaaattaaagcactaaaaggatagacgcagcgattaatgttttcaataaactggtttctaaaatgggatgaacgataatcgtaccgattgaaatcatcaccattgtctgtgcgatggtcatttgtgcaatggattttctccctgaaattctcagtaaaatcattccgaatgcaattataattaattcttcccaagcaaatctcatgttatcaccctagattgtgttttatcaaaaatgaaagagcaagtaagaggtttcttaacgttagctggggaactcaggcgtcgataaaatgttctggattgatagagttgagactcggcttttggatagacacgcgggagagaattttagtttatgtgtttttgcgtctaaaagcagaaacattacaactaataatgatcatcggatgtaataaaattacgcacctaggtgctatatgctggatcaattataaaatggagtgaaactaaaaaaaggggcaaagcccccttatattagcagctttttagttgttacttgagacaatcattccgccgtcatgaaaaatcagcttttgtagacggctgtccaagtgccatcagcaccatggaaggtgatgttgtctaaataataggtgattccattccggtaaattgaagtaggataatcagggccataaccattaagtatgaacgtcgccaaagcagatacttccttcgttttgctttctgcagaaggtgtatcagcaggacctgcggcaaaagcagggcggcagaacagagtaaagcgagtgacagggctgagccggctaaagcttttttcattttcattgcaaacactccttttcttttttaatacaattgtattattacatattatgttaaacatgtacatgcctatctttgttaattttttgtgaacaaacagataatctatttaaacgcagagatgtaataagtatgatgatgaagcaattatcatctataaaaataagatcagaaagcagatgattttctcgaaaatcatctgctcttgcgaaatgaggagttacatgacatttacggaacgggcggtagccattatcaaacagattcctgaaggaaaagtgatgacgtatggtcaaattgccggtcttgcgggaagtccgcggggagcgaggcaggttgtgaggattcttcactccatgagtaaaaagcatcgtcttccttggcacagggtcatcaatgcaaagggtgaaatcggattaagagatgaagagatattttctgtacagaagctgtctcttgaagctgagggcgtagcggtcacgtcagacggacggatcgatctcaatttatacgtccatgatccgaatatgtaaaaaacctgccgtatatatcggcaggtttttcagttatatgctgcaagccggccagaaaggttttgccggatataaggccattcctcccgaaggatggagtagtaggcggtatctctgaggccgccgtcgacagccggaatatgcgcgcggcggatcccttcaaattgggcaccgatccgcaaaatcgcagttcgtgagcgctggttgcgaacatcggttttcagcgtcaccctgacagcttgccacgcgtcaaacgcatgggtcagcaacagaagtttacattccgtattgacaccggtccgctgtacggcagaggcataccatgtgctgccgatctcacacacttccggggctgcgtccgccggccgcgtaaacacttccgcatccataaaccgcgtacttccgacgattcggtctgtttcaagattccgtactgcaaatggcaatgcaagtcctttttcataatcggaaagcgtacgttcaatataacgctttgtttcttcgattccgtcaggaacatgggtgtaagcgtaagtcgtcctattttctgaagcagcttcacaaagtgcctgagtgtgatcaatcgtcatcggctctaactgaacgagtgaccctttaagaatgacgggcttcagcattcttatcacaacctttttttatgaatggatcaagtatagtcgagcggcttatcattcaaaagggccaattttaaattaaaatggcatgtcagtgaaatcctcgcttcaaacttatgcatacattcaggaaaaaagcggaaacctttatgtgaagaggtgatgggcatggcatatgtgttatcggtcggaaccagcattccggaatatcatgtctcgcaagaaacggcggcggattttgcgagagggatgtttgccgattcatttaaggatattgaccggctgttaaaagcctttcaaaacggcgaaattgaatcaaggcagtttgtccggccgattgaatggtataaaacggcgcggggtttttcagaaaagaaccggctgtatacggaagaaaccgttaagcacagtgcggatgcggcacttgattgtttaacaaacccggattgtttaacaaatccctttccttatgaaaaagtggatgcgatcttttttatttccagcaccgggctttcgacacccagcattgaagcgaaagtgatgaatcagctgccgttttctgcgaaaacaaaacggataccgatctggggcttaggatgcgcgggcggagcggccggcctgtccagggcgtacgaatactgccgcgcatatcctgaagcatacgtgcttgtcatcgcggctgaactctgcagcttaacgtttcagccgaacgacaagtcaaaaagcaacttaatcggaacttccctgtttgcggacggaattgccgcagtactagtcggaggagaaaaggcgaaccgaaacgacgtcaaacagccgcttcttccgcggatattcgccactcaatcggtgatgatgccggatgcggaagatgtgatgggctgggaattcaccgacagcggttttcaagtcattttttcaagagatattcccaccctggtttcacagtggctgaaggacaatgttgatgaatttttaatagaatatggtgtcggtcctcacgacattaaaacctttcttgcccatccaggcgggaaaaaggtcattgacgcctatttaacgagtctttcaatggacaccggtcagcttgaggcatctcggaaggtgctgcaaaaacacgggaacatgtcttccgcaactatttttcatgtgataaaagaacagttgctccgcggccggcagaaagaaaacgaaaaagggctgatcggcgctctcgggccgggattttcgtctgagcttttgctgttcagctgggaaaagggggcttcttaatgttttggctgtttatcatgctgcttgcggcccagcggattgcggagatgatcgtggcccggcgcaatgagcagaaggtgaaaaagcaaggcgcagtcgaatacggagaaggacattatctctttctcgtcctgatgcacgtgctcttttttgtctctcttacagctgaggtggcggcgtttcaaaaaacgctttctccaaggtgggccgccattatatgtattattttatttgtacaggggatcaggtattgggctctattatcattagggcggtattggaatacgaaaattcttgtcgtgccggatgcggagcttgtcagaaaggggccgtacaggtggatgaagcacccgaactacgcggtcgtcatcttagaatttatttttctgccgctgttatacggagcgtattggacactgtttctcttttcgattctcaatgcctgcatgctcactgtaaggattcgcgccgaagagaaagcgctagaagaaaacaccgcaaaatagagattgaaaatcattctcactcatgataagatgtaaatatgaaaatgattctcattcaaggtggtgccgaaaatgacaatgttatttttatttgcagccgtttgtacatacagtgttttaattggtttcgtattgaaaaaagtttcgaataaatcgatgtcttcttaaacatctgcggtttttaatgccgcgggtgttttttctttatcagctgccgatatcggcggcttttttacgtttcctgaagaaaagtgggccattcttgtgtaaaatgggggagaggtttttttcagagctttctaaaaatgaaaacgtcatttgatgcgacagacacaaaggggttaagacacatgacagaagaagaacgccataacagggagattttcagcagaacgggtgccttatacgtacaattattggatcaccaggatgaaaaacgggccgatcagctcgcggccattatgaaaaaagcggctgatgaagaggtttatatcgcgtttaccgggcattattcggccggaaagtcctctttattaaacacattgctcggtgaagacatactgccgacaagcccgattcccacaagcgccaacctcgttgtcatccggcacggtgaagataaagtcgtgcttcatacgacggacggggcttatgcagaaattaaaggaagttacgataaaaaacaagtgcagcaattctgtaaagacggtgagcaaattgaaacggtggaagtctatgccggctttaaggagtcagagccttatgcggcctacattgacacaccgggaattgattcgacggacgaagcgcattttttatctgccgcttcggttctccaccaggctgacgctttattttacgtcgttcattataatcacgttcattcagaagaaaatatgctgtttctcagctccatcaaagaccgtattccgaatttgtttctgatcgtcaaccaaattgacaggcatgatgaaaccgaaacgaagtttgaagagtaccgcaggcaggtggaagatatgcttgaaggcgcgggaataccgaaagaatcgcttttctttacgtctgtcactgagcctgaccatcctttaaacggcatggaacagctgaaaaaacatctgcagaagctgaaacagcaggcaaaaacaaatttatggtccttaacggagagaaaagtcgcacacttagtcaaagagcatacagagatgctcgtaaaagatgataaaaacggaagcggagagcagtttgacaaacaagaagcacttgtccgttctgttgaagatgagcttaataaagccgttcaacaggctgaaacagcagagaaagacatcagaaaagacgtgcagaacatattgcaaaacgctaatttgacaccctttgagatgagggagcttgcatctgcttatattgaatcacagcagccctcatttaaaaccggattattcttttcaaaagcgaaaacggctcaggagaaagagagaaggcatgctgaattttttgccgatattaaaaaaagaacggaaggggaagcggattggcacattatcgacacatttacgaaagcggccaagcggtatgaagcggattcggacgaactgatcaagaaaatccaggcgtaccgcacaccgctttctgatgatatcaccgctcaggcccttaagcagggagcggccttttcatctgaatacgtattaacttatacgaaagacctcgctgagatgatcagaagggaagccaaaagacagacagcggaactcattgagaagcttaccgcttatgttcaggcaaaaaacggaccgctcattgagaacttgaaaaaccggctcgaaaaagaaaagaagataagggatgagctcgcgcaatcggcaaaagaagaacgcaatgccttggaaaaagcagcccgggtccgcgctttgtgggaagaagaattgacctgtgatacgggaagcggcgactggtatacgcgaaaaaaacgccttgcaaaagcgcccgtccaaaaagagaaaccaaaagagactgtacagtatgaagtaaacaaacccgaaaaaaatgcgatgaaggaacttcctataaaagagcagactgatcggttctatgagcttgccgggattcttgaatcctcgagcatattaggaaaacaggcagaagcctttcgaagcaggattgagcggcttgaaaaccgccagtttaccttggcgttattcggcggattcagttccggtaaatcatcatttgcaaatgcgcttgtcggtgaatacgtgcttccgtcatcaccgacgcccacaacggctacgattaacaaaataacgaaaccgcaagccggcaaaccgcataaatctgcggagatcgtttttaagacggaggaggatctggacgctgaaatgcttcagctgactgagctgaaagacgctgatgtaaaggggcgttcactgaaagagagatggaattatgccattaaaaaggggaaagttccggatgaacttatcccggtgattcagacgatgctgcaggcgtttgatacgtatgaagaacagatccgtcaaaggcagacactgacggtgccggtggaagatttaaaaccgtatgctgccgaagaaaaaacggcctgctgcgtaaaagaagtcaccgtgtattatgattcgcctctcacgcaaaaaggcatcacaattgttgatacgccgggagcaagcagtataaacaagcgccatacggaacttgcctttcaatatataaaagatgctgacgcgttcttttatatgacgtactatcagcattctttttcaaaaggagacaggtcttttctgaagaaactcggcctcgtcaaagaatcattcggcatggataaaatgttttttgtcattaacgccgccgatctggccaaaaccgaaagcgagctggaaaccgtcaaagactatgtccgctcagaactctcaaaagagggaattaaccggccaaaattatatcatgtctcaagtaaagaagagcttgcgggtaaaaaagcagctttttataacaggttctctgatgtaagaaccggacttgagcactttattgaggaagatgtaatgagggccagctgcgcccagctgaaaacagaggcggacaaattgtgcgatatggtggaacagcttcacgaatctcttcaccagtcggcagaagaaaaagagaaaaagaaacagcatctggagtcttcctatgaaaaagctctcgctgacatttcaaagcgccgtacgtctgaggtcatcattcgaaaagtgatgaaagatacggaagaacagctctatcacattaaacatcgcctgacattttatgcgaatgatatgctgaaaaccgccttccatccgggccttcaaaacggcgattggaaacaaaatatagcagcggcgctgaatgaagcgctcaaggaattccgttttgaatatattcaagagctgaaaacgctcgatatccggatgaccggttttattgagcgccatatgactgaggaatggatggaaaactgtcagaagaagcttatggaagacggagatttctccatttatgtgagcgccgaaaacgaatttgccgttcagctgaaagaagtcgctccggtcattgacgtctcggcattcacacatcacataaaagaagttaaatcgccgaagcagttttttgaacagaacggaaaagcagcgtttgtagaagggctcaggctcagcctgcaaaaagtgacagaaaagtggcttgagcaggagaaagaaagcctttcagagcgatatactgagcaggtgcgccgtctgcaagaagacatggcggataaaagcctgtcccagatccgcgagcagcgggacacttatttacaaggtcttgcggaaaatacgagtgcaagggaaattgaacacctttacgaagccgaaaaagcatggaaaaagaaagatgaaatgctgaaaatttaaaaatccggttggcgggcagataacagtcgtggtagactaaaatgaaaaaagcgagatgaaaccttttatgtcagaagtccataaagcaatttcagcacattccgcaaaacagcatcagcacgtcaaaacatttgtacagcttgactaccagcgtgaacaggccattgaagaagccattgtaaaatgcagacagaatgaaccgttcacgacagatgccatcaatggcattaccgcaaaaatgaaccagctggcgaaaaagggcatcgtgccgcaaagacgattcgtaagtgaagagatggtgaaagaattcgtcagcagacagtaatggatgaacctgccgcgtgtgtcatcagcgcttgctgtacatactatccgtatcttctctaaggggggatatgacaatgggcagaacaaaactgggaaacagaaatgttcagcagaataacaatgccaaaaagaaaaacggtttcggacagaaatttgattcttatgccggccgtgaagctgaaaagctgatggcaagcaataaaagacacggtgagtaacgtgacggcagcatcttccaaatggggggatgctgtttttttaccgccttctttggtaaaataggaacattgaataaaaaaaggagtttcgatatatgaataacaaattactgctcgtggacggcatggcgcttttgttccgctcgtttttcgcgacggccgttcatcgcaattttatgataaatgaaaacggaatcccgacaaacggcgtcaacggttttttaaagcatctcattacggcggttgatacgtttcagcccacacatgtcgtctgctgctgggatatgggaagcaaaacgtaccgcaatgatttgtttcaagattataaggccaacagaagcgaaccgccgcttgagctgattccgcaatttgatttagcgaaagaagcagcgcgagagctcggttttttaaacatcggcataaaaggctatgaggcggatgactgtatcggtacgctttctgccctattttccggagaagcggaaattacgattgtaacgggtgataaagatctgcttcaattgatgaatcatcaagttcaagtagcgctgctgcaaaagggtatcggcaattataaggtatatacagatgagatattcagagaagaaacgggggttccgccaaaagcgctgattgacattaaggcgctgatgggagacacgagcgataactatcccggcgttaaagggatcggggaaaaaacggcgtacaagctgatccgtgaatacgaaaacatagaacggttattagaaagcctcgctctcttgccgaagggccagcaaacgaaaattcagcaaagcttgaaagaattggagctgtcaaggcagcttgctgaaatacattgcgaggtgccgttagtctgtacgcttgaagaagcgattttttcattgaagatggaagaagcatccttaatgctcagacgccatcagataaaaggaattgaaagaatgctcgaaaagctgaacgccagagagatcagctgatccctctagcgttttgtattgcttttttttgcgttgttttcaagggctgatttcgggtctttatgcgcatttccttccatatttccctgaggattcacgcccccggtctgccggcctttattttcttttctcatagctgttcacctcatttgtaggatgaacagtgaaacgcaatttcattccggttatttattcagccggaccgctttttttgcgagctgatcggctgtttggttttgtctgccgggaatccacttaatgaaaaacaatggaaatccggcctttaagcggatgatttcatccacaaacggctggaaagccttgtttttaaccgcttcaagttccgcggcccgctccacgatatctgaatccgtccggaatgacacggactcaaatccgcgggcggcacacagcttcattccttcaattaaagcgagaaattcagcttcctgatttgaatggtcgccgatcggaattgagaaagattctgttttcccgtcatgtttaataaaaataccgataccggaggggcccgggtttccggcgcttgcaccgtccacgtaaatttcagcaggcatcatccgtcactctcccttcggtgtcattcgttttgccgcatacgcataagggacagaaatgagtgataccgcaaatttaatcaggtaagtcgaaataaagatgctgaaccatacgcccgcggaataaacgccgataaaggccacggcagtgaagataaatgtatccagcagctggctgagcgccgtgcttccgctgtttctgagccagagaagcctgtctgaaggaaagattctccgaatggctgaatatacataaacatctatcgtttggctgaaaataaaagccaagaggcttccgagtgcaacacgcggcagaaaaccgaaaatcgtctcaagggcaggctgcgcgatatctgacgcagccggtttatataaaagagccccctgcatggcgcatgtcaaagcgagcaaagtggaaaagccgagccagacggctttgcgcgcttctctgggaccgtatttttcattcagcacatccgttgcgaagaaaacggtgccgtacatgatatttcccagtgtcgccgtaagcccgaacagctcaactgttttgacaacctgcaagttggcgcacaccgtggcgaaaccgatccatacgaataggcccgttttgccaaatcctttataaaacagaagaacaatgataaaatgaatgaccgcaaataagatccataacacatcgttaaacaaaacctgctgacttcctttcaatttgagaatggtttgattatagcacacgcccgtcaactaatgaatggtaaggtgatttcaatgaatcttaagccgtatatcgaaatagaagcaaaaggaacaggccctgtcgcgtttttttccgaagattggctgaccgttccgaaagcgcgcatgcttgcaagagaagtcagccgctttccttatataaaagacatttattttgaggatgaaaaaggcgcgagctggacgcttaaagaattagaaaagcttactgaagaacttgcgtacgaacctgacgacattacagtgtatttcgacggcggctttgacaaaacaagcggacgcgccggactcggaattgtcgtgtattattctctcggcggcaagcggcatcgcatacggaaaaacaaaagcttaacgcttcagacgaacaatgaggcggaatatgccgctttgtacgaagcgcttaaggaagtgcaggaacttggcgcaagcagaaattcaatcacgataagaggggattccctcgtcgttttgcatcagcttgacggcagctggccgtgttatgatgaaacgcaaaacgaatggctggataaaattgaagcgctgctcgaatccttaaagctgacaccgacatatgaagccgtaaaccgaaaggaaaatcaagaagcggatgaccttgccagaaaaattctctcggaccggcagattgaaagccgcataacattagaaggtaacggagatgactgatattggataaaaaaagcatttataaagaattgacagagcttcaggatgaatattgcaaagactgtttcgtaaaaaagcatttccgcaaagagtttggaaaaacgcacgctcattctttctgcatcaaccaatgcacggtgggggagaagctgaaagcctacggcaaggtgctgacaaatcaataaaaaataaaaccgcagcttctgcggttttatttttcgaattcatcaagctgatgctggcaatcgtcgagaagcattcgctgcttttgcagaaaatcctggtcgagagcttgcagttcactggattgtgacatcgttctggcatcctgaatcgcctggtaagcagactccaccaaagttgaactttggccccgggtagccgctcccgttgttttctgggccgtttccaccgctaattcaagctggcgtttatccgtcagtccgtttggaaaaaattcagagtccattaaaaaacacctccgcaaatagtttggagattttttttagaaatatgtacggaaaatagaaaaaaatatagaaaataagccgatataactattgaacctgattaattagggcttatttactattattcagggtatcttgggagagaagggaaaaaccagccgtgaatgataatgatttaaaaacaatccttcagcagacatttaaagaaatatacggtgatctgggaagtttagcggaaatggcgaaaaaaggaatgccgtcaatggagaaacaaattgaagaaatcgagcagcgctgtaagcagaatcttgtcgcaattgagattcagacggcaatcaaataggagaggcatacgcctctcctctatttgtcatctgatcaacatgtattgagtttagagttttacaacattagaagcttgaggtccacgattaccttcgacaatttcaaaagaaacttcttgtccttcttctaatgatttgtatccttctccttcgatagcagtgaagtgaacaaatacgtcgtctccgccttcaacttcgatgaagccgaatcctttttcgttattgaaccattttactttaccgttttgcatattgcttaattcctcctagtactgtagcaccttcgtgctaaaaaaaattttgtcatcatccaaccgtacgtatgtaaacgttgttaaatgatggttcaactatacaccatatgggagcgggcgtcaagcggccgctccctattttttatctttatttttccagtaacaaagcttaaccggaaaaaaacaaaaagcacacgaatcgttcgtgtgcttttcttttacgataatgccatatccgccttcccggccatcatttcagattcttttataatgtcctgcaaaatgacttcagaagagttggggaggtgaaggcttttaatattgctcttcatccggttcagcttctcctcatccgcaagaagggaggtgacagactctaaaatttcttcgtggcggttgaccacgacagccgcaccgcgatcttcaaagaaaatggcgttttccttttcctgtccgggaaccggtttgtacaaaataacgggtacgccgatcgccgtcgcttccgtcagtgtgatgccgcctggttttgtgatcatgcagtccgtaatacggaacagctcgtcaattctttctacataacccagcactttcagccggtcggcattgtcaccttccaagctgctgagggattctttcagcgagctgtttttgccgcataccaccacaacctgcacctgatcgtcatgaacgagattttcgcacagttcttttacgtttttcagcacaccatgcgctcccgccataataagaagaacttttttgtcgggagagagattgtattttttataaatcggctctttcggcatcgattcctcgaattgaggcctgatgggaatgcctgtgatctttacgttgttcgggtgagtgccgatttcaatcagtttttcctttacgtaatctgtggcgacataatatttatcaacattttcatgaacccagattttgtgaaggcagaaatcagtcattacgttgaacgtggggatcacttttccggttctccgtctgtattccggtacgacaatcatcggaaatgtattgataataatgtccggcttatgctcttcgacgagctggcctaaacgtttatttcccattttaaaataaatattgaatttgcgtttattatagattttgtcaactccgtaataaaacaaacgataaaactgtttcccgattgagaagctttttaaataaaggtattgagtaacctctgaaacaatcggatttgactcttgatacaaattggaaaccgtcacatctaagccgagacgcagacattgttcgtagagcgttttggccacttgaacatgcccgtttccgtaatttgcagtcaaaattaatacttttttattggtattcaagtaaattcacctcaatgtaatcaacaacaagcaagcttcatgcatcgtaaggagttattgtctatagataaacataacacaagtgcatcattttataataagcgcgccaacatatttaaactaaatttaattgatatgttccattattttaaagttttgttatacgcatactgaatcaagagtattttatcatatttttgtcaccgtatcacttaaaacaaaaattaatcccattcatacggagtttcctgatatacgtaataattcagccaattcataaacaataacgttgcatgagctttccagcggttaacaggttctttcccgccgggcgcaaaatagtgcttaggagcttctacgtttgaaagatttctctctatgtctctctcatactcctgaagcagcgtatcggtatcatattccggatgacccgttaagaaaatctgtttttcgtcttttgaaacgattaaacagacccccgcttcctctgaaacgctgagcacattcagatccgaagccgattgcagctgctccgtattaatatctgtatgccgtgagtgtggcacatagtatagctcgtcaaatcctcttaccaatctctcatgttttttaagaacggtatgctcaaacacaccgaagatttttttcggcagctccactttctcaatgccgtaatgatagtataaaccggcttgagcgccccagcagatatggagtgttgaagtgacgttcgttttgctccattccatgatttccttcaattcttcccagtaagaaacatcctcaaacggcaggtgctcaatcggagccccggtaataatcattccgtcaaaccgtttgtggcggatgctggaaaaatccgtataaaattcatccagatgctgccttgccgtattttttggagtatgtgtgctcggaattaaaaacgtaaagtgaacttgtaaaggtgaattcccaagcatcctgaggagctgggtttccgtttggatttttttcggcatcagatttaaaatcacgatcttctgcggccggatatcctgatgaaaagcccggctttcatccattacaaagatgtgttcactttcaagcacctgcttagcgggcaggtgatttggtatattaataggcaacatgccacctccgttattccccgttaattttcttcattatagaaatttttaagccatttttcaatccatcccggcgtaataaaccgtatttaacgcataatgacagggataaaagcggcaaatgggtataaattcggagcggctcttttattatgacgggtaaagagccgtttggttcctcgaaaaaaacgttttccgttaagtggaaggaaaaagcggttaccgtttgttttgcagtgtaaaacaggtaaaataaatgaagaatgtaaaaaggagggccgcagatgacaatttacgatataaacgtacggaccataacaggcgaagacatgacgctatcggcttacagaggcaaggtgatcatcattgtgaatacagcaagcaaatgcgggttcacatcccagctcaagcagcttcaggagctctatgatacatatcgggaggaaggtcttgaaatattgggatttccctgcaaccaattcatgaaccaagaacctggaaatgaagcggaaattcaagagttctgtgtgaaaaactacggagtcacattcccgatgtttgcgaaagttgatgtcaatggggcagacgctcatcctctcttcaaatatctgacggaacaggcgaaggggatgctcggcacaaaagcggtcaaatggaatttcactaagtttatcgtggaccgaaacggtgaagtcaacgggcgtttttcaccgaacgtcaacccaaaagagcttgaagatacggtgcagaggcttttggcccgataagaggtgatacggtgaacgaaaaagagcagctggaaagcgtcaggaattgggtcagagaaaagcttatcaatgaacgtacgggccatgactggcttcatatttcccgggtcgcaacactttctgtttatatggcaaaagaagaaggcgccgacttatttatcactgagacggccgcgctggttcatgatctgattgacgccaagctcgaaaaaagcgaaaggctgacggcaggcgaagtgacagaacggctggctgctttcaacattgcggctggctccattgaggagatcgcggatatcatcacgagaatgtcattcagacacagggaactgctgataaagcggccgctttccttggaggggaaagttgttcaggatgcagacatgcttgatgcgatcggcgcagcgggcatcggcagggcttttatgtttgccggcgcgaagggtcacccgatgtacggaactcaaacaagtgtgctggcccatatagaggataaattaatcaagcttaaaggcttaatgaatacaaaagcgggggcgggtttagcagaggagcggcatcaatttcttttgcagttcgccgcccgtatccaaaaagaggccggcatcggcaaaagctaagcggcgcaatagaacgcttgtgccgactatgttagaataagtgtcagattgcgcataggaggaccaatatgaagattaaatcaatagaaccgacgccgagtccgaacacgatgaaagtgattttgactgaagagcttccggcggggaaaagcaacaattacaagcctgatcaggcagatgatgctccggccgtcgtacgtgatattttaaacattgaaggagtaaagggtgtttatcacgttgccgatttcctggctgtggagagaaacgcccgttttgactggaaggacattctgcctcaggtccgttccgctttcggaatggaacatacggagcagtctgagagccgttctgaacaggaatcgttcggtgaagtgaaggttttcgtacaaatgttcagcggaatcccgatgcaggtcaaattgacggacggcgaacgtgaagagcgcttcggccttccggaacgtttccaagaagccatcttaaagctgcgttccgaagcttcaaatgttgtatttgagcgggcttggaaagaacaaggcgtgcgcttcggggattttaccgaaatcggacacgatgtcacagaagagcttcaggccgcctacagtgatgagcggctcaaacgcctgacagaagcagccgtacagcaaaagggtgaggccaaaccggcagtgcagcggaaagcttataaagtgactttggaaatgctcgatgatgaagactggaaacagcgctatgcccatcttgagcaaatggatccggatgaagacgatttaccagtattagaaaaggcgctgcatgatccgaagacttcgatcagaagacaagccgtcgtttatttgggaatgatcgaaaagccgtctgtgcttccgctgttatacaaagcgcttgaagacaaaacggtgacggtcagaaggacggcgggtgactgtctgtcggatctcggcgatgcgagcgccatcccggctatgacgaaatcgctcagtgactcaagcaagctcgtgcgctggcgcgcggccatgtttttatatgaagtcggcgatgaaagcgcactggaagcattaaaagcggcggaagacgatccggaattcgaagtcagcctgcaagtcaaaatggcgattgaacggattgagcacggagaagaggcgaaaggttcagtctggaaacagatgactgaaagcagaaaaaaagaacagttataacaaaaaggtgcgccatgcaccttttttatttgaattcactttttataaaaattatttagaatattgttgaaaaatgattcaaaactctatatagtaagtacaatattaattgttggagggtttttatcgaaatacagaaagaatagaaaagcgagacagggcaaagacgctgtaaacaggtaatttgcagaacgcgccctagaataaactgaaaattttaaaaatagtgcacagtctaaaaacagtagggggatcaccatggcagaattacgcagcaacatgatcacacagggaattgacagagcgccgcaccgcagccttcttcgcgctgccggcgtaaaagaagaagacttcggcaagccgtttatcgcggtctgtaattcatacatcgatatcgttcccgggcatgttcacctgcaggaatttggaaaaatcgtaaaagaagcaatcagggaagcgggcggtgtgccttttgaatttaacacgatcggagtagatgacggaatcgcgatggggcatatcggcatgagatattcactgccgagccgtgaaatcattgccgattcagttgaaacggtcgtctcggcgcactggtttgacggaatggtctgcattccgaactgcgacaaaattacgccgggaatgctgatggcggctatgcggattaatattccgaccatttttgtcagcgggggccgatggcagccggccgcacaagcgacggccgcaaaatttcgctttcttcagtatttgaaggcgtcggcgcatatcaagccgggaaaatcggtgaaagcgacctgcaggagctggaacagttcggctgcccgacgtgcggatcttgttcaggcatgtttacggcaaactccatgaactgtctgtctgaagcgctcggtctggcgcttccgggaaacggaacaattctggcaacttcaccggagagaagagagtttgtgagaaaatcagcggcccaattgatggagaccatcaaaaaagacattaagccgcgcgatattgtcaccgaaaaagcgattgacaacgcctttgcgttagacatggctctcggcggctcaaccaacacagtgctacatacgcttgcgcttgccaatgaagctggggttgagtactctttagaacgcattaacgaagtggctgaacgggtgcctcacttatcgaaattggcgccggcctcggacgtcttcattgaagatctgcacgaagcgggaggagtctcggcggcccttaatgaattggcgaaaaaagaaggggcgcttcatcttgacgcgctgactgtaacaggccgcacactcggagaaacaattgcgggtcatgaagtaaaggattatgacgtgattcatccgcttgacaatccgtttaccgaaaaaggcggtttggccgtcctgtttgggaatctggctccggacggcgccattatcaaaacaggcggcgtacaggacgggattacaagacatgaaggccccgctgtcgtctttgattcccaggatgccgcgcttgaaggcattataaaccgcaaagtaaaagaaggagatgttgtcattatccgttatgaagggccaaagggcggaccgggcatgccggagatgcttgctccgacgtctcagattgtcggaatggggcttggcccgaaagtggcgcttattacagacggccgtttttcaggagcgtcccggggtctttcaatcgggcacgtatcacctgaagcggctgaaggcggcccgctcgcattcgtagaaaacggcgaccatgtcatcgttgacatagaaaaacggattttggacgtacaagtgcctgaagaagaatgggaaaaacgcaaggccgaatggaaaggcttcgagccgaaagtaaaaacaggatatctggcccggtattccaaactcgtaacaagcgccaatacaggcggaatcatgaaaatataaaacagaggcctgaacaattgaattccggccccctctatagtatccttgacttcatataaggatttttagagggggcttttttatgtcaatggcttatgaagaatatatgcgccagctggtcgtgccgatgcgccgtgagctgacgggtgcgggttttcaggaattaacgactgctgaagaagtagaaagctttatggaacaggcagagggcacgacattggtcgttgtcaactccgtgtgcggctgtgcagccggtctcgcccgtccggctgcgactcaggctgttttacagcatgaaaaagcgcctgatcatacggttaccgtatttgccggtcaagataaagacgcaactgcaaaaatgcgtgaatattttacggggcaggaaccttcctcgccatcaatggcgctgttaaaagggaaagaggtcgttcattttattccccgccacgaaatcgaagggcatgacatggaggaaattatgaaaaatctgacggatgccttcgatgcgcactgctgaaatgcccgaattccgggcattttctttttggagaaaaagatgatcacaacgagttacagaccaagcgaatacacgatacacacagcgcagtcactcagtgtcaggctgggtgacacttactgcagccgcaataaacagcccattgaaaaaatgctggaacgagccgctagcgatcttttagtcatcggaaaggaacggttcgaactttacacgaagcaaggggagaagttcttttttcacccgaatacagcgatgttccgcgcaaagcggtttttgagaggggaagccgagccgttgttaaaagcagccggattacgcgagggggattcctttttagattgtacgctcggcctggcatccgatgcgattttggcaagcctggcagtcggaaaaagcggacaagtcatcggcctggagaaaaacaagcttgtctcattgcttgtagaaacaggacttcaaacgtgggaaaccggaatggagcagctccaaaccgccatgaaacgcattcaggttaaacatgccgactgcgccgattatttgcgggagcttcctgattcatcggtagatgtcatttattttgacccgatgtttcacgaacctgttgaaacgtcagacggcattgcaccgctccgcgcgctggcagaagagggttttaacgaagagtgcatcacgcaagccgtccgggcggcgaaaaaatgcgtagtgcttaaagaccattggaaaagcccgcggtttgaacgatacggcttcaaggtgctgaaaagaaagacggcgcttttccacttcggtgtcatccatgtaagctcatgatatcatgggcttctttttcgttaatcagtgatttccataacgacaaaataaagcagcgtgagaagtgatacagtcgcaaataaagcgttaatcatctcatcccctcctttttctccttcttattgtaagcggtttatccactcggtcacagttaccaatttcccatattgcatgataatacggtgccggacatgacgccgcgctttaatctatgctaaaataaaggaaaagaggacaataaaacagaggggaacaatctatcatgaaattgtggatgaaaaagacccttgtggttctgtttaccattgtaacgttcggactcgtgtctcctccggctgctttgatgacagacaagccttcaggacagtcgagcagtcttgagcagaatgattacaccgctttttatgatgaacacgccctgacgggagaagcgaaggcagggcgggagcctgaattactgtttcaatcgtatcagcagcagcttctcggtgatgctgaaaatcaatcatttttaaaattcggcagcaaaatctctccggtcattgaagatgattacagaagtgaaattctgccgaaaatcgaagatgtcatcacaggacatttagccaagtttcaagatgatgaagcgtatcaggatgtggttatttccagtaaaccgtcggccggaaaaactgaaaaaatttttcatgtgtataacaggctgacaggtgaagatcttttaaggttccacgtccgccgggatcatcctccgcaagacggctactggtttaattttcattaccataccgctgaagacggatttcaatcacatcatgagctcggcagcatttactgggaccgcaatacgccgcctgactggatgagcgtgtaatagcgagaagaaataaaaaaatcatttctgagaaattttgcagaaatgattttttattgtgttacactactaaaagactactttaaaaggatgaaaaaaatgaaacaatataaagatttgtgccgtcatgtgttagaaaacggagaaaaaaaaggagaccgtacgggaacgggtacgatcagcacgttcggctaccaaatgcggtttaaccttcaggaaggtttcccgatgcttacgacgaaaaagctccattttaagtccatcgcgcatgagctgctttggtttttaaaaggagatacgaacgtccgctaccttcaggaaaacggagtccgcatctggaacgaatgggcggatgaaaacggagaactcggaccggtttacggctctcaatggcgttcgtggcgcggagcggacggcgagaccattgatcaaatctcccggctgattcatgacatcaagacaaacccgaattccagacgtttaatcgtcagcgcctggaatgtcggcgaaattgatcatatggcgcttccgccctgccactgcctgtttcagttttatgtcgcggacggaaaactgtcgtgtcagctttatcagcgctcagcggatgtctttctcggcgtgccgtttaatattgcgtcttatgcgcttttaacaatgatgatcgcgcatgtgacgggacttgaaccgggtgagtttgttcatacattcggagacgtccacatttaccaaaaccatgtggagcaggtgaatttgcagctgacaagggatgtccgtccgctgccgaaactgcggtttgcgcgaaatgttgattctatttttgattttacgtttgaagactttatcattgaggattatgacccgcatccgcacataaaaggagctgtcagcgtatgatttcgtttatttttgcgatggatgagaaccggctgatcggaaaagataacgatctgccttggcaccttcccgatgatctcgcatatttcaaaaaagtgacgacgggtcacaccattgtaatggggcgcaaaacgtttgaatcaatcggacgcccgcttccgaaccggcggaacatcgttgtaacctcacgggacgaatcttcattcccgggctgtattaccgccgactcggctgaggaagtgctcaagctgatcccggcggatgaagaatgctttgtaatcggcggtgcccagctgtacagtgcgctctttccctatgcggacagactttacatgacaaaaattcaccatgtctttgaaggagaccgtttttttccggaatttaatgaagctgaatgggaattgacctcccgcaaacagggagtaaaagatgaaaaaaacccttacgattatgagtaccttgtatacgagaaaaagaattaagcagggggacaagaattgattcgttacggctgccttgtgatgtacgttgtatttatgttcatgaaaaatattcaggaatatatcaatcaaaaagagcttgacccgcggctctcttttcaaaaacagatgaggctggtgtatgagcggccgaaagcctttatgagaggctgcattgacgtgtcgggatcggcaatcggcattcatcatgatcagccgataccggacggccccgtattgtatgtgcatcccagattgcgcccggctgatcttctgctgcttgcgggacatcttgaagagccggctggttttatcgctggcgagaaagctttccggatgccgtttctcggaaattggctgcgtctgatgggtgtcatttgtggcggagacagccgggatgcagtgcttcaggaggcggaagtccggctgcaaaaagggcaaagtctgattctgtccgaagacggcaaaatcaatccggaggaactggcccttcgtttcgatctcccgattgtgcccgtcagcacttcgggaacagaccggctgctgcggggcaggttattgaaacggctgaaaccggctgatattgaattacatataaagcccgcttattatccggccggtcagaaacggctccgtgcataaaaaaagcacagtctctatacgagaggctgtgcttttttatttcagataaagggaactttgacgcaataaaacaaaatacagaaaaacatcgaggcgctgccgcctaaaacaaaactgtgccaaatggcgtgatgatacggaacttttctccaaatataaaatattgtgccggcggaatacaataagccgccgaaaagaagaaggccgaaaccgggacctgacagcgaagcgtacagcggtttaatggcgatgatgatcagccagcccatcattaaatagacaagcgttgaaaaaatgataaaccgcttcacaaaaaagattttaaacacgatgcctccgatggcaagcgaccaaacaataattaaaagggtcagaccgagcgtccctttaaggggtcctaataaaaatggcgtatatgttccggctattaatacgtatatcgcggaatgatccacaatttcaagaatgtctttcgtttttttatgctggatgctgtgcaaaagagtcgagctgagatacagcaggagcattgaagcgccgaatatggaaaagctgacgatgtctgtcggcgagccgtatttcaccgcaaagataatgagaaaaataagcgccggaatcgacagcaatacaccgattccgtgtgtgacggcatttgcgatttcttcttttattgtgaacaatcaaatgtcctcctttttaaaggatttgtttttgcagtgactgcaaaaaggtcaacccttctaatgtgatttttgttcctgcgcgtcctcggccttttgtcacatagttcatcttttctaagtaatcaagcctgtttctgacttgctggggcgttaatgtcattgtgctgttttcgcttaattcggatatgctccgtctgctggcgggttcgccttttgtatttaagtctttaattgcttccaaaataaacaaaaactcttctttctccatcaatgtcagccgtttttcttttttcttagcggttttcgctttctggctgtttttgatatacggcgggacatgctcgggataaatcgtgctgccggatgctgccgcggccatatagtgcgccgcattttcaagttctctgatgttgccgttaaaggtgtgccgctcaaacagcggataaacggacggatcgatatgaacatgctgccccgaggctgtcagcatatgctgcagaagaagcggtatatcgctttttcgttcagataaagcagggagcggaaggcctaacacgtgaagcctgtaaaataaatctatgctgaacgtgttttccgcgccggtatcgccaagattcgccgtgctgcttgcaatgatgcgggcggaaagcccggcgtccagctcggaaagaaggcgggcctgtaccgagagcggcatgtctccgatttcatataagaataatgttccgcggcgggccctgtttaatgcgccttcagccccgaacagttcatattcgagccgctcttcgctttgactgcagtgaacggtaataaatagttcgctgtttctgcgggatttatgatggatcgctctggccatttgtttttttccggttccgacttcacccgttatgaagaccggcaaatcagataaggcaaattgcgaggccaatcgtttcgcttctgaaaaggtgtgatgttcgccggctagctgataaaaaggatcagtttgttcaattacactcataaattggctccttttggttctaattggtttaagtataacacgtttatgcgatcgaaaatatctttttctcttgtatcggttcatttatttttatttacaaaattaaaataattatcttattgtttgaatattcatgttataatggcatattaaatagggatttaaataagaaaggactctgtaaatgaaaccgttgcttaaagaagactctctcatccaggtaaaagacattttaaaagcgcaccaaaacgtaaaggacgttgtgatacatacgcctttgcagaggaatgacagactttctgagaggtatggctgcaatatctatttgaaaagagaagacctgcaggtagtcagatcatttaagctcagaggggcttataataaaatgaggcagctctcaaaagagcagactgaaaacggaattgtatgcgcaagtgcgggaaaccatgcgcagggggttgcgttttcatgcaaacacctcggcattcacggcaagatttttatgccgtcaaccacaccgagacaaaaagtatcccaagtggaactgttcggaaaagaatttgttgaaatcatattgacgggtgacactttcgatgatgcgtataagagttctgcggaatgctgtgaaaaagaaaaccgcacgtttattcatccgtttgacgatcccgatgtcatggccggacagggaacggctgccatcgaaattttaaatgacattgacgtcgaaccgcattttctttttgcaagcgtagggggaggaggactcctgtccgggatcggcacgtacatgaaaaacatctcgccggatacaaaaatcatagcggtagagccgaagggcgcagcctcctattttgaatcgaaaaaagccggacaagtggttgaacttgagaaaattgataaatttgtcgatggggcggccgtaaaaaaaatcggcgctgaaacctttcaaacgctcgaaaccgtcgtcgatgacgttttgcttgtcccggaaggaaaagtgtgcagcacgattcttgaattatataatcaatgcgccatcgtggctgaaccggcgggtgcattgtccgtgtcagcacttgatctgtacaaagaagagattaaagggaaaaacgtcatctgcatggtcagcggagggaataatgacatcggcagaatgcaggagatgaaggagcgctccatgatttacgaggggctgcagcattattttatcgttaatttcccgcaaagggcgggagcgcttcgcgaataccttgatgaggtgctcggtcctgatgatgacatcacccggtttgaatacacgaaaaaaaataacaaaagcagcggccccgcattggtcggcattgagcttaagcatcgggaagattacggcgcgctcattgcccggatgaatcaaaaaggatttcattacgtagaggtgaataaagatcaggatctgttccacctgttaatctgactttttttagaacggccgcgcaaaatgacagacacgctttctcagattgtatataataaaaagaaaacaatcgaaaaagaaggattgatatcttgttactcaaaagcctagagttcaaacgacaggacgggattcaggtaaaagtgacagaaataccggttatcacggaaggtgaacaatatttttttcaaattcatcagcaccttgagctttatttgagagaagtttttgcttcacaaagtgtgagaacagtgtattcattccgacaatatgtcaagcgccgtatgaagtggaaagattatgaggccgttttcagccaagagattttaaaacataacgcataacggtgcacattccttagcgccttccttttgataagggagggtgcgggaatttttttatgatgaacgctgtaagcgttttatctatgggggaatggaaatgaaaaaaatgaaaagcttcgctgccgtcttttgtttgctgctcttgtgcgcctgcggggggaaaacgataaaagacccgctgaactatcagattgagccgttttcatatcagaaccaagacgggaaaacagtgtcactgaaaagcctgaaggggcatgtctggattgccgattttatgtttacaaactgtaatacagtctgtccgccgatgacggcccacatgaccgaactgcaaaaaaaactgaaggctgagaacctggacgtgcggattgtgtcattcagtgtagatcctgaaaatgatacgccgaaacagctgaaagcctttgcttccaaatatccgctttcgcttcgcaactgggattttctgaccggttacagccaaaaggacattgaagattttgcgctgaacagctttaaagcaatcgtcaaaaagccggagggagaggatcaggtcatacatcaaacttctttttatttagtcggacctgacggcaaggtgcttaaagattatgacggcgtgcagaaggttccgtatgatgatatcctctcagatgtcaaagcggctgaggagctcaagtaaactggcagattagacattttcaaaactgaaaaaacatgttacactttccactagtagacggggaaggagcaaccagattgaagctgcgaatgttctcattgatcgccggactggctttgcttttatcagcttgttctgtccagcgcaccggttctgacgctgaagaaccgaaaacgaaagatcatattgtcatagctgcggtcggtgattcattgactgaaggagtaggagatcctgacggttcaggatacgtcggcaagacagcggagtctcttaagaaaaagggacatgtgaaaacggtagatattaaaaattatgcggtgcagggcgacaaaacgtcagacctgctgaaaaagcttgataataaaaaagtgcagaaatcattaaggagcgccgactatatcttttttaccatcggcggcaatgacttaatgaaggtgctccgccagaatatgatgcagctgacggttcagccgttccaaaaggaagagaaaccttttgaaaaacggttcaagacgatcatttcaaaaatccgcaaatataatgaaaacgcagagctggtgtatgtcagcatgtataatccattcacgtttacgctgcctgaattaaaagaaattaatggggttgtgacggattggaacaagatcgccgcaaaagagctggaaaaagatcctcacgccgctgcggtgaatgttgaagacttgttcagtcaaaaaagcggcagcagacggatttcaaaggatgatgattttcatccgaacgcaaaagggtatgcactcatcgccgaccgattatacggcatcatagaaaaacaagggttaccagcagaatagggtgaaatgatgaaaaaatggaaatcgctgttttttgttcttctcgcactcaatgtgattgccgccgcggtaattgtgacattattggttatgccgggagaacaggcgaaaatacaagatcagacaaaaagtgagtacggctttcatatcacaagctccaaagaatcacttgccaggtttgtgaattcgtacttaaaagagaaggcatcgaatcagcttgactacaaagtggacatcaataacgatgtgcacgtggcaggtaaaatcaaagcattctcaacctccattaacgcggtcgtcacatttgaaccgtccgtacaggagaacggagatgtggttttgaaagtgacgaagttttcattaggtgaattaagcctgccaatcagctttgtgctgaattatatggacagcttttatgaactcccgtcatttgtgcacgttcattccggggataaaagcatcgagatccgtctgtcagaaatgcctttagacaacggcatgtatgtaaaagcggataaaatcaatctcgacacggatgaaattgaattttcctattatcatccgaaacaataagttttcataaaaaaaacacagatcctttcagggatttgtgtttttttgtgtcagcgttttttgtctagcttgctgaacagtttgattaacgttgcaagctcttcatcagagtagcagtcaaaccgtttaaaaaagtattctgtttttttctggttgaaatgatcgacaattttctccccggcttccgtaatatggattctgataattcgcctgtcctctttagaacggatgcgggtgatccattccttttctactaaagcatcggtcactgcggtaatgtggcttgcggagacctcaagaatgggggcaaattccgttacttttttaggcccttgttcactgagaatccgcaaaatggtgaattcgttcctggacagctctttatctagaatttcattaacttcatttctgatttgtttaaacacttttcgaagcaaagcttccatatcatacatcatttgtgtccttactttcaaatcatgaacctccaatatgtagtcagcgtggcattcgttcagcttctcctgagagcagaattatttttattctgtttatacatgctataatataataataccacgtatgaacaaaggagggcacccgtatgtcagaaaaaaaagaaatcgccacatttgcaggcggctgtttttggtgcatggtgaagccgtttgacgaacagcccgggattgaaaaggtggtgtccggctatacaggaggtcatactgagaatccgacttacgaagaagtgtgcagtgaaacgaccggacacagagaagccgttcaaatcacatttcaacctgacatttatccgtatgaaaagcttgtcgagctgttttggcagcagatcgacccgactgatgcaggcggccagtttgcagaccgcggaagttcatatcgggcggcgatatattaccataatgatgaacaaaaacaaatcgctgaagcctcaaaaaaacagcttgcagaaagcggcatatttaaaaagccgatcgtcacagacattttaaaggctgagcctttttatgaagcggaaggctatcatcagcacttttataagaaaaatcctgatcactacgggcgctaccgtgtaggttccggacgtcaaggctttctggatgagcattggagggacagataagatggcttttaataaagaagaaaaaatcaaatcattaaaccgcatgcaatatgaagtcacgcaaaacaacggaacggagccgccgtttcaaaatgaattctgggatcacaaagaagaggggctgtatgttgatatcgtatcaggaaagcccttgtttacatctctggataaattcgattctcattgcggctggcccagttttacaaaaccgattgaggaagaagaggttgacgaaaaactggacacaagccacgggatgatccggacggaagtgagaagcaaaacagcggactcccacttaggccacgtatttaatgacggcccggggccaagcggtctccgttattgcattaactctgcggcactccggtttattccgaaagacaagctgaaggaagagggctatgaagcctgcctgcatttatttgaaaaatagagctcagcaatgaggcctgcctatcagacaggccttttttctatgtttttttttcttcatgtaatcgttcaataatctttacgattgtttcttttgtgatgagcggcgcctgatccgattgatatctggggagattgaccttccgaaattccggatgtttggcgggatccggcaatatcgcgtaaagattgccccattcatataaagattccgtctcatgaggagaggtcagttcttcatgaagcttctcaccggggcgttttcccacttcaacagcggctggctgcggcagtccgtgccggaacgcatattcttcaaacccgtgaagcagttcttcaagcctcagggactccattttaaaaataaacgtttctccgccctttgtaatcgccgcagattgcagggtgagcgttgcggcgtcatcgatcgacataaaaaacctcgtcatgtttttatccgtaatggtgagcggaccgcctgccatcaactgctcaaataaaataggaataacggaaccgcgtgaaccgagcacattgccgaagcggaccgaacaaaacaccgtaccgcggttttgaacatgatgattcgcctgatgaaacagcttctcggacaacagcttcgtagctcccattgtgtttaccggggaaacggctttatcggttttttaagacatttactgcattttgaggaactatcagtggcggtgagatcgaaagcgtaaaattaaacttcaggataggggtgatttcaaactgagccggaattggcccttttctttttgtgtcatcgtaacgataacttctttgaagaccattcttaatagcgagttctttttttctgtgcttgtttcaatgtgatattgatcaattatcttatttatgttgtttctgactgtattactgtctatttctgattgcgcttcttgagttccattgagttcatgcttggcaatctggagttctttaaattcttcatctaaaacagcttttcttttcaaaaaaagttcatcagtgtaaatgccgctttcatatttctcgaagataaaattctctttgttttttaactcttgttctttttgtgaaagatgttcagacatttgcttctttgttttcacattactatttacgtcttcgtatttagaaatcatataaatgatatgttttgttaaagtcttattatctaagttgcttaaagaagagaggtaatccagaatggcattttcaacatcgttatatctcacataagtgcatttattctttttgcaagtgagtgatttaacgtgatacacactttccgtgccgtttttgttttctcgcgttcgcctagtttcgtatttagataatggttcaccgcacttagaacaagtgcatacgcctgccaattcacttaattccaatgcgtttttattaggcagcaggggaactttgtttgcaattttctcttgtgattgttgaaattgttcttgatctattatagggacgtgtgcatccgatactataatttgttccttttcaggtctaattgttcgtttaccgtcttttgttttttccctaaccttatatttaacagttccgatatacgcttcgttttgcagaattgctttaattgtgtattgattccagcgcttttttcctgatggagtcggtatttgtaattttgttaagtgagaagcaatcgctgtataactaacttcttttccattcaacccatttaaaaagatgttaaagatgaattgaacgacttttgctttttcttcgactgggactagtttggatgtttttttgtttaaccggtatccataaggcgctagtcctgaaatccatttcccttgtgccgcatatgtgtatttagcgcctgtcatacgctctctggtcatttcaaattcttctctggccataaacaattcaaaacgaatctgacgcatgtctgcaggatttcgagggtcataaactttatatggtgtaatgataatcaatcgcttactttgaagaaggttaacaatttgtcccgcatcactgtagctcccgcggctgagtcttgttatttctttaacagcaattgcctggtacttgccttcctcgaggtctttaagacattctttaaaaacagggcgaccctcaatgctttctccagatccgatttccatttttaattcataggggatttcaatcgacttcagtattttattcatgagttcattttgttctgttagcgtatcttcgcctgttcttttttcccgctccatatcctgacgagagcgtctgagataacccaaaatatttgtaatgttgtaagaatgaacgatgttttttaactccaaaaaaacagcacctcctctttattgtatttactgtaaaaacagaagtattcgtacaatattctgtctgacattgaatacgagaataacctaaattctgaagatgaaacttttctcgtccagttgtcaggtgcattttgtaattatgaaaatgataaagcgaaagaaatgaataaacaactattcattaaccgatacggtgaagagcttggaattagctccattaaaggagataatcgatcagaatatgaagaaattattcgtacttatgaaaagaataattacaagcagaaagaaattaatatagatgagctgctgcaggcattatttgagacagagatgatgttatctttaaaagaaaagttttgataaaatcctaattgatgtatcataggggtttaatcagccactataggccacagagtccctcacacgctctgtggttttttgtttagattgaatgtaccaaataaaaaagaagcctcagaggacttcaaactggctctacggataggatagtaattaaaacagcaaataacacttacattttgttcaccacaagtgctgcttcaattatgaataaaattgttactgattaacaaattcgtatcctcagtaattattctgaggagtatgggggtgtttttattgactaactttgtccataagactatcaatggtttgaaaagtcttttagatgaaaaaggggctattaaattgttttgttctgagggatatattgtagagagccttgtgactttttctccaaacaaagcgtctcttagtgaaatccaaaactttcagtcgaatcataaattcactcttcctgatgattacctgaagtttatttctcagcataatggtgcgaaaattttcgaaattctttcagagggcgagaatattggaggaggtcttcatctatttagccttgaagaaatagaagaagaactaaaatacgagcttttgtttgaaggtatcaatggaatacctgtggctacctgttggaagaatgtcatttaatgatcgacaaggatagagtgaatcaaggtgatcctaattatctatttatatttgaaagtggttcagaatataatccattaaatttaaactttgaaatatttttagaccgatatattatgtcgaacggggatgctttttgggactggaaatactatacagctgaaaattattacaggacgagataaaactgtgtatgacagtcggaacggactgtctttttctgttaatcaaataataaagctatggtaaaatttagacagaaagaagcagaaaggagacgtaaatgaaagtatttgaagcatcctcgttaatttcagtagcggagaaacgggcaaaagaatacgatcagattagagaacaatttatcaatctcagaaaagcgtttcagggaatggctgatttagatgacaatgagttttcgggcaaaggtgctgataacatcaaggcattctttcaagatcacgcaggtgttacagacagctggcttgatctgatcgatatgaagattgcttttcttaacagtatttctggaaaagtatctgatgccggattgaccgattcgtttgtggaagagtcatttttagaacatgaactgattaatgcgaagaataaatcaaaagctatcatgcaggagcagcggaatgaaatgagggatattcttaatgagataagcgatattgttcatcttgatgttttctcgacagaggatgtcgatcaaaagctggattcagcagataagaaacgggacaataccgtacacaagctcggaaagctcgatcatgatctaacgaaggaatacgcagaaaccgaagcgaacgagaatttcatccaagcagactttcaacagctccaaaatgccacgggtaaagggaaaaacgcaacaccacttcactataacgtcaaggcgtacagagaaagtgtcatacataagaaaaaaggcgagattgcaagacattcagatgcttatttgacgattaaaaaagaagaagcgaaagagcgagaaatcaaggatctgaagaaaaagctctctgatggagtaactgatcctgatgaatacttggagattgccaagaagatcggttacgagaaccttgaaccttcccaacaacaatatgtgatgcagcttgaacaagcaaaacagatggaagaagccggagaagtgacctgggatattttaaaaggagccggcgtcggcctttatgatgtcgggaaagacacggtaaccggtttgtggcagctgatcagcaagcctgatgaagttgttgaaggtatcataggggcagttgcccatccaattaacacgtataatgccatttcaacagctattgaggaatcgtatcaaaaagatatggtgaacggggatgcttactccagatcaagatgggtgacatatgcggtcggttcagtggctgtggctgtcgtcggaacaaaaggcgcaggagccgttaacaaagctgatgcggcggggaaggtcataaacaaggcaggacaggcaggtcagaaaattaaggacattaagatttcagatttgcttccttataacactaagtatgatcttgctctggctgataacgtaccatacaatgtggttaacagccaaaaccttaaaaatggacttttgtccagtgcaaagaaattggatgaaagcagaaagccatttactggtcagaaagtaaatgtcccttggttaaataaagagaagtatgaggcctatgaaatagacggcaaggtaaaagttaaaggagagcctagagatgtaagccgtagagtatacacaatgaaagatattgaccttaatcaaaaaaatcgtaaaggctttacgaatcttcaactgatgaaaaatggtaatgctccgtttgctaaagatggcacgcaaataaatttacatcacttaattcaagaagagcctggtactatgctggagatacctgaaagctggcataataagtacagtgatgttttgcatggattaaaagggaatggacagagttttagaaatgatcctgtgcttgataaacaatataaaagtttcagaagaaggtattggagatggagagctcagcaatttgagaatcaagaataagaggtgaaagtttaatggattattcgaaaataaaaactttctttgatgaaaataaagaaaattcaattctcacggggggagtcactgaagatcagattagagaaatagaagaggagctcaatgtaactcttccagacagctataaatggtttttaactgagtatggttcagggggagcatacggaacaatgattctcggatatgactctcacggcgctgaagttgtcgagcagaccaatgaatataaaaaatattataacctttccgatggtcttgtagtgatcgaatatgtagatgaattttcttattgtcttgacactaacaagatgatagatggagaatgcccagtcattctttgggataaccaagagggatatggtaaacaagttgctaggacattccaagagtttttaatagaagagcttgaagaatcgaaagacgactggatcgatgatgaggactgggacgattaaaactaaaaagaaggtctatatctgtttttccatagcatatgaaggagtattaaaatgagcttcactaagatcaaacaaaagttgaaagagtttacgattaatgctggcacagatcctagcattaatacaaacgagcagctcaaagaaattgaaagaaatataggtaatcaattgccttccgactataaggattttttgaagggatatggaggctgttatttagaaagtaaaaaaacaacagatgaggttgagtatgacgtttgctacaaacctatagagaaagatccttggatgggtcaggaagatgatacacaattaatagagagcttctatggtttagctaacgatcataacagtctccaagaagcaatcaatacttattctgatcgctttcccaggaacattattcctatagcaagctcggcaggtgggaatgaaatatgcatggatatcgataatgaaaagatattgttttgggatcatgaattaagtcaccccgataaagactttttccttattgccaactcttttgaagagtttattctaagtttagtagatgaaccaattgaaactgataataatgacagtgatgtggaaattgaggttttagacaatgactttgcaaaattgctctttggtaaggacaattagcttttattgttaggaaaagtattgcaaagttaagctctcagaaagagagcttttttattttcgatagaaactaattataaaaagggagagaggttatggattcgtaccaagtaaagaaattaaaacccgaagaataccataagtgtaataatatttgggacatggaaaagaaaaagaaaatggctaaggtgttttatgacgaattagtaagcggaaacagaattacttttatttactcagtgaatgacgagtttataggagaaggatcgttagtttttcaaaacaatgacccagattataccattccggataaacgcatttatctgtctcgtatgattgttaaagaaggatattgaaattgcgggataggcggtattattgttgattatttgattgattatgctaaacaacttggatttgaggaaataacattcggtgtagatacagataacttaaacgcaagacatctatatgaaaagaagggctttacaaccgtattatttcttggtgaagatgaatatgtaaaactccttaaagtattaaaataaaattcccgagaattatggtgaatgtgtgggaggttactttcacaaacgatgatagacggtaacttaagctaatctaattcgttattaagatacggattagcatttatcctctcaaaaccaacccgtaatgaactaggatactgttggctgaggaattatttttccatgtattgtattttatggtattcttgaaatgaaaggaggagacaatgaaaaagaaattaattggggtcttgatcattgtttgtttttctgtgttcatgtatggcgcagttacacattcttttaaaaatcaaaaatccactgaggaagtattagaaagtgcatgggatgaatttggcttatttagccttggaattggagaaacagacccagtcatatcaattggtatggataaaacaaaaaatgaagaagaattacgacgctatctaaacgataacttatctaaggaagttaaagaagaatataaagttgagatcattaaaaaggatattaaggttttagaaagacaacatgagaagtatttggaaagtaataaagcgcattgatacattaaagatgcttatcggctccaaatacaataatgattttatccaataaacaaaagttttgcaaaccattccaatggtttcatttaatctgttataatcaatctgtaaaatacagactggttatagtgtatttctttaacaagaaatgcataaaataaaaagagcatggtgttggtcgcaacccatcaaagggcttgctcagatgttatgttattcatgatagacctaacccttcaggttatcaggctcaagggaggtctattttttatttatatacgtcaacagggcgattataaacgacccaaatgcaagcattcacattaatgcctgaaatgttgacataagcatcaccccctttctatagggggtgagcaagactccaagactccaagattcccttaagtgagcatacttaatgtacaggaatcatttatatgtcgttaaaaacccattcagttacctatgcgaaaagaaccatgttagaatcaggttcttttttgaatttgagttaaataatcggctggaattaccgataaataacatgtgaaataataccaaggaggttaagggattgaaaaaagtacttagtttagtaacaattacacttcttgctgttacaacgatgttttccattagcacatcgaaagcaaaagcaattgaagcaacaccgctttacagtcttcagattctttccgtcacatcggatggaaacgactttgtatgggagcctgttacaagcagcaagccaaatgcaacaaatgttttgaaaggtgacaagctgcatattaaagttcgctttatgggctatacaaattcgaccgtcattaaagcaaaggatgggagaaatttgttatacaaaggtgaagcgaacatatacaaatatgaccctatacttggacaaaacaaagttgtgataggatgggacaaatacattgaaattccaatgaacgaacttccttcaaatgagattcaagttgaaggtcttgggaaaaacatgaaaatcatttatagcaacgttgtaaaattcgagagaggatgaatgttatggaaggtctaaataactcttacaatatcacgaaagatccgaaatttttagcgttttgcagtttagcgacagaaggtgcaggaattagttcgaatacgcaatgttcaattggttttaatgaattcaaagaagcgctggagaatggcaaagtagttgataataaaaaccttaaaagcagttcagagttaaatcaccagtttgattactggaagtccagaataactgggggacgagctgtaactgaaactgataatcaagtgttagatatcatcaaacaagcatacaatcttggaatggttacgaaagataatatgcttttgagaaatcaagccattaacgcgtataaaacatctatttaatttaaaattaaagccccttattcaggaaggggcttttgctttgcaacttattctttatgtttaatctaaaaccataaagtcctgcacttttgtttcttcttcaggcaaatcaaattcattaagtttctttttagtacggatatcaaaaatccccatatagccaccaatcccttttttgttttcctcttgtgaaattacataaagtttttgatctttaaactttgcattcatatacggaaattttaaatcgaatttttcaaaagaaaaatctttatcgtactcaagtaagcaggcgtatacggatttattaatatatgtaacgtaaaatttaccgctttttttgtcgtaatacacagcgtccgcttgttcgagatcatcaggatattttatgaattttgatttccatgatcctttttcgattacagttagttcatgttctgagctagctacaacatatttttcagagtgatcaaatacatctccataggaagctaatccaatcgttttaataatcccttctgtgtttctatcaatgacgtacatagacattccttgaatgacgtaaatatacctattatcgcttcctcccatggttacgagggtaggcaaagtcaggctatattttttattgaactttttatcatttactttcagttcatttccattggtgtcgacattataggcttttacagaaatatcttctccttgataccaaaaagcaaatggattggataatttatgttctttaatagtgttgttttttaatgtgtaataatatggttcatgttcagctaacaagacgatatcgtctgaagagggggtttttttctggatatatggtatatccggtaccttaaagtatcgtttattgaatttttctccttgtgatgtggatatgagtacgcttttcttgatgagtggatttgaatagataaaaaagattttatcctcggttggatttattttagaagtacttacagagtgttcacctttatttataaagaatgcattgatcaacaatataactattgcaccaattagaactcctgaaatcccatataaaacataagactttttcatataacgctccatatcttttatataaaaaaacacacttgcagaataaatctgcaaagtaaatgattaggagcagacagtttttgatgagcggtcaatatccagatgtgacaagtgcttctccattactgtttaggtctgttccttttgtgtttttgtatgattgccacacaagtttagaggagcaatactatttatttgtgctttttttggttgcagctatgaataaggcttacctgttttactatgaaggacagcattgcatagagctttacaggtgaacacagatcataaaaaaacaccccctatgcgggagtgccaaaacatttatgcggtttgccctctacgttccactgagaagtcattatggtgatcaagcgcgatatggatactggctgtgtggcctcttcgggcttctttaaaaactttgtggccgtcaagaagataatgtccaacaagcccaagtaagataactaaaaagataaaagccgatgcaaatttaaatttcataaagacaatcccctctctgaatttgttttcgggcataaagcactttctcataaaaggctgtagctactttatggtcttcatttacattataatacattgctgcatcagtcgctaggtcttccacatccgaaagcatagcttttgattctaagtaatctaagattttaaaaagtcgttctttgtcattctcaacgaataaacccataagaaaatcaaacatttttcctaatacgtcatcgttcaactcctttgaaagcataagaccttgttcacaaacctgttttccatcgaccgtgttgaataatttaaagtgcgtttttgccaacattagaagtatgtcaagcagtcggctagaattgtgaagagaattactttgataaattgagacgccttctttaaaatactccaatgccttctccatatgtcctgttgtaaatgagcataaaccgagattgtacaaagaagaacctattaaccgcggcatatcaatttcttgtgcttgttttaatgcattcatgaaatgcggtattgctttttctggatactccatgtctaaataattcagaccgatgacgaatgaacattggattactcttattgagtatgtctcgtgtgctttgtaggtttctattgcttgaacaatatgatgcatagacatgtgggtttgcttcatgtgatagtacacttcagcaactttgtagtgaaattcagctcgctctatttcatcggggacaatagatatcttcttttcagctcggttgtaaaaacttattgctttaagatattcgtactgttcaaattcatacatcccatgaaaaaagttaaaataatattcaagaattccttttagatcgctttgtttactttcgatctcttctgataagtctgaaattttaggtcgttcttcattcatggtttttggttcaagataatcaagcattaattgatgtcgaaaacacatgagcgaatagtacaacaataaatcttgatcttcttccatatgctctatttcttgttcaacttcaccctttagaatttctgcatctgcaacactgaataatcttatgtatttgtaccatttattgatttttaagccaacctttgaagaagagatcaattgctccaaaaaaatcaccctcctagtatttcgactgattatgtaatattttatcataatgtaatatattaggaagagtgttttttcttaatttctcaatttggtgtggaatgcgatagaagccccctcgttcgagaaggggatatgatcaatttcctgttgctttcagtgaggcaagccactcatctaatgttccggagaagccttgttgaacggctaattcatatgctgattttccatctttaccggcagcgctagtagcttcagtactgcctttttcaccttttttttaatgaagctaaccattcaaaagtgatgaatattcaaggcgggagtaaggaaaattaacaaaaaatgtgagggaatttagatgaaacgatttattttggttatacctttattggctgctgttattgtctctccaactcaaatgaaagcaagtccaatgccttgtagtgcagtactcgaaccggtgaatcaaaaattgaaaaatgcgaagggtgcggcactaatctataaagtgcagttatacccgccaagtgctgcgagaacgaatatgagtattcttgctgtccaccttcctcagccatcttcttatggaagctacgacggttatgaaggatttgcctccaaaacaggggagatcagttggcgatttaaactatatccgactcccgagggagagagtcctaattgggctggaaggattgattccatatcagctgaagtgacaaatgttcaagtgcaagtacgcctttcaaattctaagacgcaaaagttggggccgagtgtattaacaaataatattcaatcttgctattagaaatgtagagctcttatcaaagaaagaaatgcgactggatcttttgaaaaaattctggtgaaaaatgaagaagagtccattaaggcggagtccaatgaatgatgaggaattaagaatcattctgaaatcaattcatcattgacagaacagagccggcaaaagtcgatattgcgtttgattttgtacaagaaagacggcataaaaagaaatggttagctaaaaaaaggcaaagagtcaacgctctttaccatcaggtgttttccttaagcggtctgcaatatgcttaattaaactcagcgcagcagtcactaatccaataactaaagcaatctcaagtaagaggataattccaaaatttaaaccgagactttcaaagtaatcaccagtaaaagagagcaattgataaatcccaagcatcagcacaataaaggaagcgcctataatcgccagagactttttagagaactccttagtatggttaaaattataaaccaataagaacaaaaatagacaagccatggcgatcttatgagtcaatgaatcacttgctgaaaacccttgcacaagtaaggagataattaatccggtcattccgattattttgttcaatatatcacctgctttgtataagtatgacttagatgtcagcttaccaattaaaggtgaaattctcaacataatgcagtttaaagttaacttaaaatgtgattattttaagaaagaggttgaaatatactcgattgtcaaaaaggggagcaagtaaggtctttgagaatggagaaatgggaattatattgtggacgacaaatcgaggttctgtaggtgttgaatgggactctggtgaatatggtgaatacaatgataaagtcgatgagctatttgttagcagattaatatgttttccgaaagttagacgaaagcagttcattaaaggaagggttagacaatgattaaaataacgctattccaagatgaatattgcaatggtgaatgggttgaaattgataggctattaaatatatttataagaacagagtcaattaatattgaagttattgatatcaaatacaattcactaaatactgtgcgaactcaaatacactctgcgtatatatagagaaaggacttaagatcactaggaccgaagatgaaatcgtgattttaaacgtagtaagaggaagaaatgaaaacctatgtagcaaccaaggaaactgagtactttaccaatgaatccattgaagaggtgctttatgctggtacaataaagaagctgcgtttagcaaaattgatggcacttcaggcaatagactaattttagatgtttgttttgatggcttgaggattaaatcttttatcaaaattcataatggtgttggcgagtagcttttgataaattggccagcgcaaagaaagaggttgaagactacaatgccaaactaattgaggcaggcacaatctctttgaaatgttggagagagctggacaagtctagataaaagatagtttttattcaaatactcaaggcagagcctatcgcacctacaatgccaacaaaatcaactagtgttgttacgttgctcataaagtcaaaagaattgtttattagaaacataaaatcagcccctgtgaaaaaatttaacactaagataaaaaataataagaagaaggattttatcactggcttgttttttgtgtaggagcagccttgaatattcgattgtattactaatatatcaaaatttctacaattaatccaattctctcttacgatagtttttaacgaatacaaaaaagccccacgaatggagctgctagattacgtattattgaacatagccagaaaagtcgctcggagcagagaaagatagatagtaaagcgcattggcatctagattttttattgttcctgtagctgtaccgttagcatttacagttagtgtttcagtagcaaaaatccagtcggaatcattccaaactttcacagttagtttagttccaatattatttgtaattgaatagcttatcgaagatttgccttgaaaataactgtttgaatataacgtattgccagttgcttgtccagcgaatgtcaatttgtttttcgtaagatttacaacgctatttgaattaggagggttaagaccaaaagctttaaattcactttcgacagagttagtaagcttagttgaaaacctagaattgtcggtctcagcagatgcggcagtggcaatgctcagagaaagaatggccaccatggtgcaaacaataaaactaaacaactttttcaaattaaacactcctttatttgtaagttaaagtaaataataacatttaatttcaggaggtcaatgggtttattcaaactggaatgaatctgtcacaaaatatgaagagcattttggtgaattacagctaaacgatttggataacttattgtattatgtactgaattttcagtctgttttgctaagcattaaggagttatgtaatagagagattatactctccaagattcaaaggaaggtatgcggagtttaccatgtagtcttaaatctataatcactttcagccagctataagaatgtttattaatcccatatggagagttagctttattaatacgacgattccttcaagatgcttttcattggcagattaaagtaagctaatccgtttccctgcagaccttcaataacaaatacattgttatggtcaaggttaatgtctaaaagcatgcttttccgttcagtgagcgggttattagcaattgaatgccaattaatataaattatatcgactacacagtaaacgatattataggcagattttttagacataaagcgtcccattacagtctcaaagtcaggaagcaaaaacaacagtaccattgagcatatcaagattcgagatttctcaacttgcttgttactttattgttgtaaacgagtataaagctggaaggttcagtgtagctttaggagccgaattgcttagagaaagcactgtatgaagagggattttaattaaataaagcagacattaagcctgctttatctttttgaacattattccttttttatatgaattaatgttctcaccaaatgcccgtccttaagattttaaattctgggcacggtcagactttttagggaaaatacattctaacaaaagaaaaaataaagttaatcctaatgataatttaaaattgtcgctgttcccaatggaacataagatacccactatataaataaataaaaacctaaacaacgaggcaaatataaacttgaagaagttatccccaatgagatgccttccaacagccacaaaaatattatcaaaagtaaaagaataaacaaccatacacacacttgttataacaatctgtttaaattctatttctaattcaaagaattttacaagcacatttgctgatcctgttgcaaataagattatcaccattatgattgcagtaggaatgagtgataaaaccaaagctcctattactgtagataataaaaatttttcatttgtgtttttttctgcagcttctttcttttctcctctgtacataaaaataaaaaagacgatgagagataaaagataaattgataacgtcataacaagcagattcatggtaatctctccttacctaattaaaacaaaagagtgaaggttgtaagcctcactctcttgtttttaatgtatagttataccaaaaagaacacaacaaccttcgcaattaactgtgcatcagctaatggaattccggctttcactaaggccacagtaacagctgtttctccgaaatttgtaagttcatctataacgtccgccgctttgtgtccccacttagaacaagcatcaccagctttttgtgcccatttatatgggatctttttaataaggtttcctaaagcggggccaccaaccctaagtgcttttactaatatttgtttagcgaaaggaatgccctgtgtatgtacttcaggatttgaagctaaaggagcctgtacgctattttgaactacaggtgcttttttactttctgctgcacttgcatagccaggagaaacaactgatatagccagcacagccaacgtgaacaccatgataaatgaaataagttttttcttcatttcttcaccatccttaaataaccattagtttaatatatttacaaatataatggatatttgtaatgaaatcaatatattacctaaaaaattttagttataaaagaaggaacaagaattttaaaaacatacttttgttattatacgagacacaattttcttaaaaaagaaccgaaagtctcattggggatgcccattttatgccgtggagaagattcaataaaactgtaggtttaacaaaaacaaatattttcaggagtgtaatatcataaaacactcagaggggaattaggtttaagaaacaccattggcaagattgaaattgttggaattttactggagtggtttgctttatgattttggggcaggagttaaggcgaaaagagataactcagacttggaatgatactgaaagcaacgtctacgatcaactttgacaaatactcaactgctgctgtcgttcaaacattaggatttgcttttaatttgcctacaggggctggtcatctgatttagctggattagctaataatgatcattctaggtgaatataaaattgtttacttttaggataagcaggaatgtaagatggcagggacggctcttatgacaaaacaccttgtaacgatttatgaagataaggatcaaaagaaaaaatcgggagtgacagctttatcatcacagacaaaggcggcccaaaagttgctgcaatgtgataaaaaataaccctgtcttaggcggggattattacatgctgtttattatgctgtaaacaaacgcaacaataaataatggataagagataatagcaattagttttgaagatttgctctttttttcaaatgtgtatattagtgcaaatcctaaaaagaatattgtgacaaaccaagaagaataggacgggtacaatgcaataagtaagacaataagagtggataacgcaaaagaagagtcaagtgttattttctgatcgtttttcaaataaaccgcctccttacacatattccacattagatcgcttaaagaaggtgttgtggttgatcagccaattaaatatttcatgatgcaattgtgcggttctatgatggtaaagacctcgccgtgttccataagactacggggaagttgttaaaatccttaaaaatgagtcgttttagtctgtcatttcctaaaacagtgttttactcttgttacaaatatgcaagaagggcggtttgaacttgtatagattatgtacaatgctgttaattttgttaagtataacattagggtgtcaaaacccaaagcaaacattttatggaggctgagcaaaccatggtcggctatgtcattttaaaaggagagaatcaagcaattttcatacataatgaaaaagctaatgttaaagactatgaaaatcttagtgaaaaagagattattaaaaagtatagatcggatatagttttactgggacttagtcaacttaacaataaagatgacttgagcaaaggacaaaaaattcgtatttggtataaaagattcaatgaatcttcaccgccaaaaacaaatatctcaaagtttgaaagtatttagtatttattctttgattcccagaaaaccgctgcaaaactgaagcggcatattgaaccgaaataatgtcttcaaacctcacgtcattcttcattcgcggtggcttattcctgccccaggatttatttgacaattgttgactcaggtgcagagaaggcatatgtcaagaacacattttgaattactgggcaccttgaataaagccagcattcccatattcatatgcgaagagatcggtactgaacgctggatcatacatttgaacaagcttgcgaggctttgataaagaaagaacagtcaagagacgaaccattacatacatataatactcctgtgaaagcgggggtgtagttttggaaccttaccaacgttatgaggaattaaagaaaaaaacaataaaggttgtccataaagataattacagtatccgctatatagatcaggatgaagcgagtaatgacttagatgaattttataaacaatttgctcagcatttattggaggctgctttggaaaggagtgcagagtaagcttctttttttgatttgtttgtggtaagtatcttaataaacggctttatcagtactgatattaatcacatgcgtcacttcttgcagcaaagccgcttctgcgacattttgtccgccgataaggttggtttgaatggcttcaaagggattatcctcacatgtcggaacctgcttcagcgcagctgtgtgaaagacaatatcaacacctttcatcacttggttgactcttctgtagtcacgaacatcgccgagcacaaacgacagtctttgttcatccgcgtatttttgcttcatcacatattgtttactgtcatctttgctgaacacaatgacttctttaggggttaagagcaaaaggcgttttactatttggcttccgattgatcctgttccgcctgtgacgagaacagttttatcgtgaaaaaacggttgtagctctactgcttgctgtttaggcatggcttatcctccaactctcgtttctctaccatgcatcatatgttgaacaatttcagcgagttaatgaaagaaaccaataaatcaaaaattagagaaaaacattaatctgatgcgctttcatatcgcgttacccgattaatagaatagaaattacaaataaaacattgtactaaatattcattttaaatatttgctcacgtcaattttttctcttcataaatcctcacattcggacaatcttcacaaaaacttaacactgaacttcctgtatgtattttacaattaaagtgcacgttcataaaaggaggatggaaaatgaatcattcaaaaacacttttgttaaccgcggcagccggattgatgctcacatgcggtgcggtttcttcccaggccaaacataagctgtctgatccttatcattttaccgtgaatgcggcggcggaaacggagccggttgatacagccggtgatgcagctgatgatcctgcgatttggctggaccccaagaatcctcagaacagcaaattgatcacaaccaataaaaaatcaggcttagtcgtgtacagcctagagggaaagatgcttcattcctatcataccgggaagctgaacaatgttgatatccgttatgattttccgttgaacggaaaaaaagtcgatattgcggcggcatccaatcggtctgaaggaaagaataccattgagatttacgccattgacgggaaaaacggcacattacaaagcattacggatccaaaccgcccgattgcatcagcaattgatgaagtatacggtttcagcttgtaccacagtcaaaaaacaggaaaatattacgcgatggtgacagggaaagaaggcgaatttgaacaatacgaattaaatgcggataaaaatggatacatatccggcaaaaaggtaagggcgtttaaaatgaattctcagacagaagggatggcagcagacgatgaatacggcagtctttatatcgcagaagaagatgaggccatctggaagttcagcgctgagccggacggcggcagtaacggaacggttatcgatcgtgccgatggcaggcatttaacccctgatattgaaggactgacgatttactacgctgctgacgggaaaggttatctgcttgcctcaagccagggtaacagcagctacgcgatttatgaaagacagggacagaacaaatatgttgcggactttcagataacagacgggcctgaaacagacggcacaagcgatacagacggaattgacgttctgggtttcgggctggggcctgagtatccgttcggcctttttgtcgcacaggacggagagaatatagatcacggccaaaaggccaatcaaaattttaaaatggtgccatgggaaagaatcgctgataaaatcggctttcatccgcaggtcaataaacaggttgacccgagaaaactgactgacagaagcggaaaataaacatgaaaaaagcagcttatccaagctgctttttgatgtgaagagcgtttcatgagaaagtcttggaacggatagccgtaagcacagccggcagccggtcatacgtgtacgccggtactgtctcttgataattaagcgccgcgatttgtttacgttcacccgggtttgtcatataaaaatggatcttatccgcaaaatccgcaaacccgctgtaagaaacaaatgttgaaaacgggggcgcgggagaaaggtctgtcagctgaaaggcctgacaagccgcaatgtctaagcttctcgtatttaaactggtattttcgatgccgcgtccgttctgattgagcgcaaaccgataagaacggtgagggtttaagaccacctctgcgctgttgtaatataatgcggcaagttcgggttcaatccattcatccattacgagcacattttgctgtctggcgatttttttaggcagatgtctgcgccatcccttcccgataatacgaagcgtatacggaagcttcgccgctgctttcaccagttcaacgcggttcggatacgggtatccgatcagaagcagatttgtgtgaagagaggcttcagcaggttgttttttaaaaagccgctgattaacggggatcgggacataatatacgtgctgtaagcccatttgccggtaagcatcaagcgcgttttgttctatcgttaaaacggcatccgcaagcggcgcgattgtcatactcacatcgaaataaaaaggatcctccgtcatccatagatatacgggaatctgttctgtcttcagccattgaagccattcagacggaatacggtctcccgtcatcatcagactgatgtctggtttgaatgcccgtatactgcggatggtatcttcctcaaactcagaaacagaaaaaaagcggacggaagactgtaaaaagccttcctcgatccagcggtcaaaatacgtgtatatgcctttatatcctgaacggatatataaaacgttcatatgctgttacgaagtgaacgtgacactttcaactttgtcgacgtcaagcaatgttgtagcagagcctgccggtgtaacggaattttcctgcgtaacaaaaacgattccgtgaatttcgtcaaaggcaacaaattgaaccgggccgatcatgtctcctgaatccatcacaatgctgatgacagtgccgggctgaattcttgcaaaaatccatctcgccgctaatgaaataccgcttcccaatacagattgtgcgctgagactgtctttcgccgctgcttcatccacttttgcatcaattgccgattccaataaatcttttactttgttttccacattatctcctccatctgtgccgccagataaagcgctgttgtcaaatacaggggctaaaagagtttttaataacttctttttaagctccaaacgatcctcgctcatgcggacatacacctcctttacaatttcaacctcacgtttattcatattcctgattgaaaagattggtataagtcgaatgccgttttgcttgcatttttttcaataattaatcaaacagctgaattttcgaatcaggctttgtttgcctatgcggattgtaagagtatgacatacgttgtatagattaaaaaatgaaggagaggaatattttggattcaggagaaactgtaaaacacgggggttttgaggaggaatttcagctcgtactgcttcttcttcttttgttatctcatcagccgtccggagatcattcagatttgcggcgtcagcttgtaatggcaaaagagcttggggttcctgtgtcgcgcgtcaatctgattaacggcagcacactgcagaacgtaattgtcaaagaagtgctgtcagatttggccgtttttcaaaatccgctcaataatacgagatcaaacgtcgcgatttcaagcatcgtcagctgggggctttttaataacgatatcaggctctgtctctttcggagccgttttttacgttttacagaaggggtgatgggatggaaaagaagatctcaattatcttaacgagttacaacaaaccggatcttgtaaaacaggcgattgaaagtgttttgcatcagacctacagcaattgggagctgtttgtgatggatgatcattcaaatgaagaaacctcggccgccatcagtacgtatataaaagatcatcgcatatattatgacaacagttttatcaatccggccgaacggctgaagtcgacccggtatgccgttttgattaatgatgcgctttcacgggccgaaggcgaatacatcacttatttgacagacgacaccgtatttcatccgaataggctcagccgcatggcggaagcgcttaatcaatgcagcgagtttgatgccgtctattccagccagaaggtgatacatgtaaacgggcgcggaacagaacaattccacttctatcgttttgctgaagaggtgcttgatcaggccgcttttctcgttgatcactgttcagtgatgcaccggagatcattgcttgagcgtgtgaaagagaagttcggcagcttttgggacgaagatgttatgcattggaatcacggagactctgttttttggagcaggctcaacacatttacatcatttctgccgataaaagaagtgttggatacgacctataaaacaccccactcatttcagaacacgtatcaatcgcttccgtctgtcctgatcgacggatcctttgtaaaggggacggatcagaaagtatatcagcttgaccgaaataaaaggaagcctgtaaacgagcgctggcatacgttatacgaaggccggaccgtcgtcattccggatccgtttttatttcaatatgaggaagaggactccgccagtattccgaattttcagctcgtcagggatcagtttcatgtttattttatagaagacggggagaaaaggctggttgatcatagcgcatttcgcttttaccgatttaaacggcatggcatcccggctttagaacgggccgaaatacaatcgcttccggacggtccgccgatcagccggtggacatcggactgtgttcaacatttgcccgggaggatgctgtttcgcattgaacggaaattttatgtttatttgagagggttctccatccgatcagtcatgacgtagcgaaacgattttttgcgaatcagaaggcgatacccatttcctttcagcaaattaaacaattaccaattggaatgccgttctatccggtgtacgatgaaattataagaaatctcaatataacaaaaggttgagagatgcagtcggatgtgcaaggaaaaggagagcttttatgaccgatcaatttgataaaaccgagaagcagtatatagagcttacttccggcattcagaggttcgagcatttcagtgtatatacggacccttttttgccgcagattttttcgcataactttgttcagctgcaccgtacatttccgttagacaaactgctgccgtttctttcgtccgttccgggcatgcttcaagccaattatattcatgtgaaagcgtctccggagcacgcatttccgcttcttctgaaacaaactttggtaaagcagggctgcgtagtggaagatgagctgttttttgcaaggaaactggaaaatggggacctgcaggccggacacccgctcactgcttgggggacggaaaagagcctcgccgatgggtcgtctattatgaacatctatgatgccctttacattggcgaggcggcggccgaacaaaagcttgagcggaaatatcctttgtataaggagggaacggttatgcttgtcgtgtgctacagcgacgcctcgcaaacgattccgatcggctgcggagagcttttcatcaacaaagcagataaaaccgcaaaaatagaagaagtcgcaattctggatcaattccaacgaaaaggctacggatcgatattgatgaatgagctgatggcggcggcaaagctgaacggcatggaaaccgtataccttgtgacgtccgggatggacggtgtaaaccgcttttatgaaaaactcggcttcaaaagatttcggcgcgtgcatacaatttttcattattttcttacatagttgggcattcgcataaaccaattgggagttggcccgcatacaatgccgtatatcgtaagaagaaaggatgatttgcgtatgtacggatacggatatggctacggttgcggcagttttggctatggttacgggcacggcggctgcggaggcggaaccagcacttttgtgctgatcgtggtattgtttattttattaatcatcgtcggtgcggcttttatttgttagactgaaaaaatcctataatgaaaatcagcctgcagagaacatcattttctgcaggctttttgttatttccatgctgaaaaatcagcttgaaaaacattttaatacatattacctttctggagaagggggagaaaatgtgaacatgacgattgaagaattaccagaatccagaattgcttatttccgaaacgtcggagagtatggcggaaagcaaaacaaagaactgatggagtcatttaaaaactgggcgcaattgaatggtctgcttgattattctgtcattttaggaattccgcaagatcatccgaatcgtactcctaaagagaaatgccgctatgatgtttgtcttgttatcaatcaagaccatgtgcctgaaccagcccggatcggtacattttccggagggaagtacgccgttttcttgcttgatcatacaaaagaggcagtcagcggattttggaacactgttttttctgagatcgaaaaaaataatttatcaatcagagaacagcctattatcgaaaggtatactttacaaaaggtgaatcatcatttgtgtgaaatattgattcccatacagtaaagaagacgggaattttccgccttctgcttatactgattcagatcaaaaatgatgggatgagcagataaatagcagaaccgaagaaagaataaaatcaacaataggaatagaatttccagaacgctcttcaggctgtcgggacatttccggcagcctgttttacagaaaggtattttctgcaaaaaactttctgaaggataagaatgcggttattcatctgttcatacaatgaagcaaatgggttttcgaggtggaaagatatggggagctatttaatcaaaccggagcttgacgcaaattatccgtcagtcagtcatggtaagggatcatatgtgtatgatcaggaggggaacaagtatcttgacggagcatcgggggcggtcacttgcaatatcggccacggcacggaggatattatacaagctttaaaagaacagcttgactccgtttcgtttgtgtatcgctcgcaattcaccagtactccggcggaagaactggctttatttctggccgatcatctgccgggcgggctgaattggtcattttttgtaaacagcggctcagaggcagtcgaaacagcgatgaaaatggccgttcaatattggcaggaaaaagggcaataccaaaaatccgtctttctatcaagatggggaagttaccacggcattactttgggagcgctttcattatcagggttctatgaacggagataccgcttcacccagctgcttgaacggtttccggccgtttcagcgcctaatatgtatcgttcagagctgcagggagaggaatttgtgaaagctgcggcggctgaactggaaacggctgttcagcggatcggttcctcatttatcgcgggatttgtcgcagagccgattgtcggagcagccggggcggccatcactccgccggcaggttattatgaagcgcttgaggttgtctgccgcaggcacggtattttgtttattgcggatgaagtcatgacggggctcgggagaacagggcggatgcttgcttctgagcattgggggattgcccctgatatcgcggtgctcggaaaagggttgggcgccggttacgctccgattgcggcagctgttgcgtctgatgacatcattgaaacgatcaagcggggctccggggtcattatgagcggacatacgtacagtgccaacccatactgtgcaagggcggcgcttgaagtgcttcgctatgtcaagaaacacgagctgcttcggcagtcagaggaaaaaggcgtaatgctgaagcggaaattagaagaaatcaaagaccgcagcggggtgatcggggatgtccgcggtaaaggcctcctgatcggggttgaattcgttaaggataaaacgacgaaggacgttttttcgaaaaaacaggccttcaccgaaaaaatcattaaagcggcaaaaaatcggggcctgcttatttacccagcaaagcccggtattgacagcggagaaggagacgccgtcatcatcgccccgccgttcacgatttcatatgcggagctggatgagctgtcagatctattttcccagtccgcagaagaagctgaaaaaatgatgaagaaggattgagctgatatgtctatttttcataaaaaaatcgatattcatgaagcaattgccgatgtcaaggacgaatctgtcatcatgttcggcggttttgggggagtgggttcacctccgtcattaatcgaagcgattttggaaagcggcgttaaagaattgaccgtcatctgcaatgatgccggatttccggaaataggtatcggtccgcttatcgttcataagcgggtaaaaaggctgatcgcttcccatatcggctcaaatcctgtcgcgggcagacaaatgactgacggagcgcttgaggtggaattttcgccgcaagggacgcttgctgaacggattcgcgcaggcggagcggggctaggcggtattttaactgatatcggcattgataacgcaaccgtttgtgaaaacaaagaaaccgtaacgattgacggaaagtcctatttagttgaaaaagcgctgacggctgatttcgcttttgtgtcggcacatattgctgatgaattcggaaatctgacgtttgacaaaacggcgcgcaacatgaaccctctgatggctgctgcggccgaaagaacatttgctgaggcggcagaaattgtgcctgccggcgaacttgacagcgagcatattgtaacgccgggcgttttcgtggagggtatcgtgcaaagtgaaggagtgaagtggagatgggcttgggaatagcggaaagagagagtatcgcgaggcgggccgccagtgaaattacctcaggtatgattgtcaacctggggatcggcattccttctttagtgccgaactttctgccggccggcatggaggtaatgctgcaggcggaaaacggcgtcctcgggatcggcggtagtccggagcgcggagaggaggatgagcttttatgcaatgcggccggatttcctgtcagtacagttaagggtgcttcctattttgattcagctctgtcttttgccatgatcagaaaagggctgatagatattaccattttaggcgcgctccaagtcagcaggacaggtgatctcgccaattggctcgtgccggggaaaaaggtgcccggaatgggcggggcgatggagcttgcccaaggcgcgaaaaaagtggttgtcgtcatgagccacaccgatcagaaaggccggccgaagctggtcgaaagctgttcattgccgcttacagcagcaggctgtgcagatctcatcattacagagaaagccgtcatcagcatagatgatggggcttttgttcttgaggaactgctgaatggcacgaccatagacgatgtcattcaaacaacggatgccgaaatcagattgggagaatgttttcttaaaagggggtctgtccatggatcaattagaaaagaaagtcactgagtgggcggaagaaaacacagcaaaagcggtaagcctgctgaaacggctgatcggggaaaaaagcacgttcggccatgaatttaacgcacaggcagtcgttttagaaaaactgagacagtttgacatggatattgatgtctgggagccgagtgtcaaacaattgaaagagcatccttattttgtatcggaacgcgaagacttccatgaaagcccgaatatcacagccgtaaagaaaggggccgggggcggaagatcactgatactgaacggacatattgatgttgtcccggaaggaaatcccgccgcatggacgtatgaaccgtttacagctgttgaaaaggacggcaaagtttacggacgcggttcaacggatatgaaaggcggcaatacagccctcttgtttgcgttagaagcgcttgaagcctgcgggattacgttaaaaggagatgttctgtttcaaagtgtcgtagatgaagagtgcggcggcgcgggaacactggcggctgttatgaagggctacaaggctgacggggcgcttattcccgaaccgactaatttaaagctgtttgttaagcagcaagggtccatgtggttccgcattacggtaagaggattgtccgcacacggcggcacccgctatgaaggggtgagcgccattgaaaaaagcctgcatgtcatcacagcccttaaagagcttgaacacgtccgtaacgcccgtatcaaagacccgctttatcgggacgttccgattccggttcccattaatatcggcaccgtccaagggggaacgtggccatcatcggtagctgaccgtgtggtgatagaaggcaggtgcggaatagcgccggatgaaacgcccgaagcagtaaaagaagagctggcaagctggctgaaagatttggagtaccgggatgaatggtttaaacaccaccccgcggaaatagaatggtttggggctcagtggcttccgaatgatctcccggatgagcatccgctgatttccgctctggaatcttcttttgagaaaatgaaaggggcaaaaccggttcgtgaagcgtccccgtggggaacggacggagggcttttgcagcacgcgggacagacgccggtcatcgtcttcggtccgggagaagtcaaggcggcgcatcaggcgaatgaatacattgaagtccgggcgttaatcgatgccgtcaaaatcatttctctttttatcatggaatggtgcggggtggcagatgggggtgacagcgctgataaaggaactgagggctgaaagcggagcggccgagattgatgcagaccgtttcaacgagcggatcagggtcattcgttatgacggacagcccgaggcgcttataccggccgttttggcagaagcaaaggaagagggagcccaaaaggtgattttctttgccaagcgcggcgatgagccggaatttgtcaagcatctttttattattgagggtgccatagacgggtattacaacgggcataaggctgttgtgatggtgcgctatttatcagaggaacggagacggtcagattcatatgtatcagaagattcggctgttgaccgtttatatgagacaccgcggcggggaatgactcagacagaaagcacgctgatgttcagaaaagcggacgaagatgatgcggaccgtttaacgcacttatataaacatgtttttcttacctatccgactcctgtttttaatcccctttatattaaaaaaacaatgaaagaaaacaccatctattatgccgcattcgatcaggatcgtctcattggggcggcaagcgcagatatcaatccggttttggggcacgcagaaatgaccgattgcgcggttctgtcagattacagggggaactccgtaacggcacacttgtttaaagcgttggagcaggaactcgctggccggggaatcattcatcttttttccttggcccgtgcagcgtcttacgggatgaacgccgttttgtatcatgcgggatacggctacagaggcaggcttgtgaacaactgccgcatttcagaagggctcgaaaatatgaatatatggtgcaaaactttacgtttggccattcataaggaggaattcgtttgacaaacaaatggtttcagccgaagcgtcactggaaggagattgaattgtggaaagatgtgccggaagaaaagtggaatgattggctgtggcagctcacccatactgtaagaaccgtcgatgacctgaaaaaagtcattcatttgaccgaagaggaagaagaaggcgtcaggatgtctgtaaaaaccattcccctgaacattacgccttattatgcttctttaatggatcccgataacccgagatgtccgatccgcatgcagtccgtgccgctgtcagaagaaatgcacaaaacgaaatatgaccttgaagatccgctgtttgaagatgaagattcaccggttcccggtcttacgcaccgctatcctgaccgcgttctttttctggtgacaaatcaatgctcgatgtattgccgatactgcaccagaaggcgtttttccggacagatcggaatgggggtgccgaaaaaacagctcgatgcggcaatcgcttacatccgggaaacgccggaaatccgtgactgcctgatttccggcggagacgggcttttaattaacgatcagattctggaatatattttgaaaaacctgcgtgacattccccaccttgaaattatcaggatcggaacgagagcgcccgtcgtatttccgcagcggataacggataacctttgtcagattttgaaaaaatatcatccggtctggctgaacactcattttaatacgagcatcgaactgacggaagaatcggttgcggcgtgtgaaaagctcgttaacgcaggtgttccggtcggtaaccaggctgttattttagcaggcattaacgattcggtgccgattatgaaaaaactcatgcatgatttagtgaaaatccgcgtgcgtccgtactatatttatcaatgtgatttgtcagagggaatcggccatttcagagcgcctgtgtcaaaaggattggaaatcattgaaggactgagaggccacacaacaggctttgccgtgccgacctttgtcgtcgacgccccgggcggaggcggtaaaatcgccctgcagccgaactacttgctctcccaaagtccggagaaagttgtgatcagaaacttcgaaggggtgattacatcttatcccgagccggaaaactatatcccgaatcaagctgacgactattttgaatctgtttttccgggaacaatggccaaacgcgagcctgtcggactgagcgccattttcgcggacaaagaggtttcgttcacaccggaaaatgtatcgaggatcgacaggaggaaaacgtttacatcaaaccctgatcatgaaacgctgaaagaccgcagggaaaagagagatgaattgaaagaaaagaaatttattgcacagcaaaagaaagagcaaaaagcaggatcggaagtcggaggtgagtcgccgtgaagccatgcgagtggtgcggcaatcagaaggcgtcagcttgtcaggcggctgtgtactgggagcttcctgacggtacgagagccatagaaattacagaaacacccgcattcgcctgctcctcctgcggcatgacgtatcaggaggaagcggtcatagcggaaatcgaaaatcagctttttttagtcgatgcaaaaaaattaccggaaacactcacatatcaagagctgatggggacagaacggatcttgaaacggaattattttgacttctcctagtcttcttttgttgtaatttcacacttgaattgtataatagtacaacaaaagacagtcatcaggaggggaaacccatgaaatccttttatcactatttgatgaaatacaggcatcccaaaccgcaggacgcaatcagccggtttgcgaatcaggcatacgaagatcacggctttccgaaaacgtcaagcgattatcacgagctcagttcttatttagaactgagcgccgactatttagaaacgatggcgacatttgatgaagcttgggaaaaatatgagaccgaggtgcatcacgcctgacgaaaaaccgcacattgtgcggtttttttctgttgaaatcaatcgcttatgaggtgccgtatgatcaaatcccgcaatgcctttcgttttgatcagcgcgtaaacaagtcttcctgatggcacggatcataaggcagcagaatgtatagctgcagagttcaccggatcagacctgctgccggcggggtcccgtgtaaggagcctcttttcacggagaaataatcaaacatttaaatgaagtgagaggaatcaaatgatctatggtgaggcactgacgtttggacggaaaagggaattttatgtgacaaggttgaagcggattgaagttgtggcttcattgaaagccgaaacgagtttggttcttcatgataaacaagccattgcagatatgcagccggaattggatctccatacatcttcgatgatgtgtttcacggcaaattttgaacatcacggcggtgatattgtcaacatgccttcgggccgggtatttatctttgtgtcatggagaaataaacaaaaactcattcaaaaacaggcgctttttgtctcgtcattgttactgctcattcgatcgagagcgcaatgccatcagacgcttctgttacggtaagtgaaaaaacgcacaagcatgttggggtttttgccattttgaacaggtgcagaaatagatatttcctgtggttttcatgcccatgcgaaattatggcggccggcatacgatagcgtatgacagtccgcggcaagggggagacagcatgaagccagataaaccgaaatttcaagtgggagacatcgtggtcgtcgtgatgtacggaaccgtcggcaccattacgaaggttcatcaaattgataaacattatctttatgaagtcaatcataatgaagtgctttattttgaatcgtccatccagctttataaagattatgagggcgtgatcgtcgatatggaaaaattagatattgaatatgaatttctgatcggcgacgtcgtatatgtaaaggactacggaaaggaattattccgagttatcggtcacagaactgaaatatggagatatttagaggatggctgggaggatattatttatgagctgactcggctgaaagacggagagtggcttgaaacggaggaagaggatctcacgctggttctgagaaaatatgaaatggatcagtttgtgcatcagctgctgtttgtccactatgttggggaagcatctcatgagatcggcgaggataccgtcgcgtctgctcttcttcagtttgaaggcgatgctgatgatcccgatgccctgcatgtgctggcggtatcgattgtagatgagctgcttgatatttataacgattataagattctttatcatttgttcggtgacgaagaatataaagatatgatgaattttgtgctggaaagcctgcgggagcatttcagctagccggcaaaaaaacggacggtgacatataaaaaccagggcagacagccggcaaagatgacaaacgacattcctttcagcactttttccaatacgatatcaaatccatctccgtccaataaagccatcattttcgtcattatcttttctccctccggggcttgtttttttaaaagtatatgagcggacaaaacgtttagaactttcgggtataatttgaacggttttttcataaaacataaaaaaggaggcggtgtttgcatgaaagaaatagatcttgtgattgacacagaagaaatagctgattatttttacagtcagcttgctatgcgcgggtacataccgagtgaagaggaaatcttcgaaatagccgacatcacctttgattatttattagaaaaatgtatgatagacgaagagcttgatgaagactgaaactgcggaaccgaagtgaaaaagcttcggttttttcaatcagctcgggagaatgaaacatggggggaaaacgttgtacaagccagcaagtcttttcgcattgtttattctgctcgcagcagcgatccggatagaagccgtccgggcttttgatgagcgtgtgatagaagcggctgtcaggatcaggtctgtctggctgaatgaattgatgttatggataacggagctcggcacgaccgcggtgcttttgccgcttcttcttttgacaggcgcagctctgtatatgtacaaaaaaacgccggatgttgtttttttgccgcttctctttctcattgaacggattgtaaacataaaaataaaagaattgattgaaagagccagacccgcttttgaaccgctcgtccatgaaacctcatacagttttccgagcggccactccatgaattcggcagtgatgtatcccgtcatcgcttactttttgatcaagcatgttccgtttttcacgaaaagaaagagggccctcaccgtctttaccggagttctcgtcattctgatcggattcagcagaatttatttgggcgcgcattttccgacggatgtccttgccggattcagtctcggactttgcctcgtttcgctttttgcgctctttgacgaaaagtatcatccgtttcgacaaaaatagagacaggaaaaatgagaaaaaacgctaatactattaagaaataagagggagggatcttgatgctgttatcgctgcccgtgtttaaaaaaaagacttgtgcctatgatgtgacgatttttcaaacaccccgctacggcgagaaaaagggatacagggtcgtctatcggacagagctggccgctgacaatcatcaagacgcactggaaagggcattttctgtttttaatgtgcctgatacggtcccaaacgactatcaagccagattcatagcgaccggagacgtcatactcatagacgaaggaagaaaaggaaagacctattacaggcttaaccctgcgggatggagtaaaattaaccggctgctcgtccagccgaggtaagacggagccggctgaagattcagccggcttccgtattgtctgggaaagacagtgttaaggcttccgtttagcggcggaatgctcttttccatgcgcttcatcagctgcaatgacgtctgaaacgggcacgtgattgttctttttctggccggtcacccggttgcgctgttttttgcccattatgttcactcctttttctttaggcttgtcatcccgcatattctgcccaagattgccctgatcaatgctgatgattgtctcttaccgttattcagtgtacaatgggtgggagtttgaataggcaggaggaaaaggaaatgagtgtacatataaacgcagaaaaaggccaaattgcggatacagtgcttttgccgggagatccgctccgagcgaaatttattgcggaaacgtatcttgaaaatgtggaatgctataatgaagtcagaggaatgtacggatttacgggtacatataacggcaaaaaagtatcagttcaaggcaccggcatgggtgttccgtctatctctatttatgtgaatgaactgattcaaagctatgatgttcaaaacttaatcagagtcggctcatgcggagccatccgtaatgacgtgaaagtgcgtgacgtgattttggctatgacgtcttcaacggattcacagatgaaccgtgtcgccttcggcagtgtagattatgctccttgcgcagacttcgaactgcttcataaagcgtaccaggaagcgcaaaaaaacaatcttcccgtagcggtcggaagcgtattcaccgccgatcagttttacaatgaagactcccaaatcgaaaagcttgccagatacggcgtcctcggcgtagagatggaaacgactgctttatatacgcttgccgctaaatacggcaaaaaagcgctgtctatcctgactgtaagcgatcacgtattaacgggagaagaaacaacggcagaagagcgtcaaacgacttttcatgatatgattaaactggcgctgcatactgtatcgtaaacttgagatgagggttatgctgattaaagcagccctcttctttatgcatcgccctgattcaaaaaaagaaaggtaagggtaaaatgaagaaatccactaaatggttctcgctcgctgccgctctcagcgtaaccgcaatcgtgggcaccggctgcagcatttcagacggcgacagccataaggacacaaaaacagcagctgaaacaaaacaatcagatgacacatcaagcaaaaaaacaacgaagacagaaaacagtgattttgtattagagagcaaatattttaatgatattaaagaagtgaacgggcttgagaccattcaaaacccgacaaatacacttgcgctcgtaaataagacatatacgctgccgggagattataaaccgaatgatctcgtaatcccgaaagtcgaattttcttttactgagaaaatcgagaaacgatatatccgcaaacctgccgccgatgctttggcggaactattcagcgccgggaaaaaagaaggttatgacctggttgccgtttcaggataccgttcttatgacagacagaaagttattttcgataatgaagtcagtctgaaaggtgaaaaaaaggcgaaagaagccgtcgcatatccggggcaaagcgaacaccagacggggcttgccatggacatttccagcaaaagcaacggatatgagctgaatgaggcgttcggaaacacggcggacggcaaatgggtgaaagaccatgcgtatgaatacggctttatcatccgctatcctaaaggcaaagaaaatgttacaaagtatgagtatgaaccatggcatttacgctatgtaggcaaaaaagcggcaaaagccatccatgaccatcaattaacgcttgaagaatattttaatgaagtaaagaaagtgtaatgagaagaagcccgcttgaaaaatagaaagcgggctttctttattaccagaagagcagacctccaagcgcaaatccggtaatgaaaccaaggccgataccgtaggctgctccccagcctccccagcctcctccccaataaccgaatccgtaccctctgtgacggccgccgacaggggtgatatacactttgctgttagtcacccgtacgattcttccgacgtggactctgccgtttcgttctgtaattcttgctacttttccttggtgctgccggcaaagatgataatagttttgcatcttttctcctcctatccaacctatctttctatgtcagcttatgatagagtgcggtaaaaaggttggacgaaaacaggaggacaattgccgttttacttgtaagcgacaaaagcgcagtgtcccatatattcacggtacgtctgcataagctcgtaatgagccgtcagcgtatcgtagtgaaccggctgaataacgggcgataaatccatttctgtagtcggctcctgcgcattgttttcatagacagcgggaatgaaatccgctttctgaaagccttgctgaagcaatctctgtttccatgcggtttcatcctgcaatacggtaaaaccgtagaagtcttttatctgcgtgatggcgttttccggcatgggcttttgtaaagcagcttcaatgccgatcagcatgcccccgggtttaaggacccgcaggatttcagacagcgatgaatcaagatttgaaaaggtgagaactgattcggaaagaacggcggaaaattgattttcagcaaacggcagccgctcaagctccgctaaatagcccggaatggttaagccttcagcggcaaatcgttttgctgctttttcaagcataaggggatccttatccacacaggtgacgggatacagcaggtggccgagataagcggccgtctgtcccgttccgcagccggcgtcaagaatcggttcgccaggaggaggagccgcttttgtgagaacggctttggaaaaagcgagcccgccggggtgagcccctccgactccgaataaggacagcatttctaaatatttgctcaaaggccgaatcctccttttttcctcagcatatgttgagagaaaagcataggtttgggtaaacgggaaagaagggcgcctcacgtttgaagttgacgaatgagcgttcgtctatgataataatgtaagaataaaaaggtggtgttttcttgaagcggcaatttaaactgttttttattatattgatcactgcggtcgcagcctcagcgcttacgctgtttatcacgggcaatacgaccattttcggacaaggctcggctgctttgacgaacagcaaatttgagaaattcaataaagcctatgagcagattaaaagtgattactatcaaaaaacagatgacagcaaattagtagacggagcgataaaaggcatgatcagttccctggatgatccgtattcttcttatatggatcctcaggaaggaaagtcgtttgaagaaacaatttccgcttcgtttgaaggcatcggcgcacaagtggaagaaaaggacggcagcatcctgatcgtatcgccgattaaagggtcacccgcggaaaaagcgggggttaaaccgaatgaccagatcttgaaggtcaacggcaaaagcgttaaaggccttaatgtaaacgaagccgtcgcattaatccgcggcaaaaagggaacaaacgtcaagcttgtgctgcacagagcgggtgtcggcgatctgaacctgtcgatcaaacgtgacaccatcccggttgaaacggtgtactctgaaatgaaaaaaggagacatcggcgaaatccaaatcacatccttctccgaatcgacggcaaaagagctgaattcagccattgacagcctcgaaaaacaaggagcgaaaggatacattctcgatttaaggggcaacccgggcggcctgatggatgaagccatcaaaatgagcaacatgtttatcgataaagggaaaaatatcatgcaggtcgaatacaaagacggcacgaaagaagtcatgaaagcgacgaaagagcgcaaagtgacaaaaccgacagtcgtcctcgtcaatgacggcaccgcgagcgccgcggaaatcatgtcggctgcgctgcatgaatcatccggaattccgctgatcggcgagaaaacgttcggaaaaggaaccgtgcagacggcaaaagattacagcgacggttctaccgttaaactgacaatcgcaaaatggctgacagcggacggagagtggattcataaaaaaggcatcaaaccgcaatatcaggttaagcttcctgaatatgcgaacctgccgtatttagatgcgaaaaaaacatacaaatacggggattccggaacgaccgtcaccaatgcgcaaaaaatgctgaaagcgctggggtacagcgtgaatgtaaacggcacgtatgataaagcatttgaacaagcagtcaaacaattccaagcaaaagagaagctgaaacaaacaggtattttaacgggagacacaacggcaaaactgatgacggatctgcaaaaacagcttgcggacaacgatacacaaatgaaaaaagccgttgaaacattaaataagaatatgaaatagtaaaaaacacccgatgcgtcgctcgcgcatggggtgttttttgtttgcgaaaagcccgtcttatgtcgtttcctgttcaaaaaggtggctgttcgcctgaatgaaaaactgtgattgctcatagtgataggtgacttttgagaaatcaaacggctggccgttggttaaatgaaaaatcgtttcaacgcaaagcttaggcgctcctgtaaacagacctaagtactccgcttcttcctcatttaacatccccgcgtacagatataaatctgaaaaaccgcgctttaacccgagaccgtctctaatataatcaaatatggattctgccacgatctctttattcaaatacgtaataatggatttgttgtaaaatgactcttcgatacacaatgtcagcccgtcaatatatcggattcgcttgacataatacacgtcgccgtcaggcggcatattcagattttgagcagcctcaggcgtgggttttctcacttccagcgctaataatttggaagtgacattaaaatcttcaagtgattctttaaatccctgattagaaagcagactgatatacccttttcttttattccgtctgacaaaaatgccgcttcccctcacttgaaacacaatcccctttttttctaataaatctaaggacttggttatcgtgcttttgctcacgttaaaccgggtcattaaggtttgcagcacaggcagtttatccccttgctgcagctgatgttcttctatgtatttttcaatatctatcgcgatttgctggtattttaacatatccattcctcattcatttattgtcccgcttctttcagaattatagcataatcgtttttaaaagccatttcgtaaattaactataattgtttatgtattgataaattataccggtacaattataatgtaaacgtataatatgaaaatgaaggcaggaattcttctacacctgcgaagcggtgcttgaagctgctgcagtgcatttattcggtatgcaagcggcagtcaaataaaggaggatataaacgatggggacattgccaaaagattttttatggggaggcgctctggccgcccaccaatttgaagggggatggaataaaggcggcaaggggccgagtgtagtggacgtcatgacggcaggcgcgcatggtgtgccccggaaaataacagatacaattgaagagcgggaattttatccgaatcatgaagcgatcgatttttatcatcgttataaagaggacatcgcattattcagcgagctgggcctgaaatgtttaagaacgtccatcggctggagcagaatttttcctaaaggtgatgaagcggagcccaatgaggaagggttggctttttacgaccgggtgtttgatgaattgctgaaacatgggattgaaccggtaattaccttgtcacattttgagatgccgctgcatttggcgagggaatacggcggtttcagaaacagaaaaacagtcggattttttgtgaaattcgctgaagtgtgttttgaacgctataaacataaggtgaaatattggatgacgtttaatgaaatcaataataagatggatgtgaataatccgatctttttatggacgaactcgggcgtcgccgttaaagaaaacgaaaacgcaaaagaagtcatgtatcaggccggccatcacgaactgctggcaagcgcattggctgtttcgaagggaagagaaatcaatcctgagttcaggatcggcgcgatggtatcacatgtcccgatttacccgtactcatctcaccccgatgatgtgatgctggctgaagaaacgatgagacagcgctttttcttcccggacgtccaggttcgcggatattatccaagctatgcgttaaaagaatttgaaagagaaggctatcagatacactttgaagacggtgatgaagagattttgaaaaatggccgagtggactacctcggattcagctattacatgtccactaccgtaaaaagtgacgtgataaacgataataccggggatgtggtaaacggaggattgccaaacggcgtggaaaatccttatattacagcgagtgattggggctgggcgattgacccgaccggtttacggtacacattaaaccgcttatacgaccgctaccagattccattatttatcgtggaaaacggattcggcgccattgacacattagaagaggacggttcaattcatgacgcttcaagaattgaatatttatcgtcacatataaaagctttggaaaaagcagtcacatatgatggcgtggatgtaatgggctatacaccatggggaattattgatattgtgtcatttacaaccggagaaatgaaaaaacgctacggcatgatttatgttgatcgggataatgaaggcaacggttcaatgaagcggcttaagaaagactcatttgaatggtataaaaaagtgattgaaacaaacggcgcatatgtatcctaaaggtgtaaaaagggaaggcttcaccgttgtgtgaagccggctttttatcagtaattatgaaagcgcattcattaaaacgggaaggaggtgactgtccggcttttcatttagaatcgcttataaaaataaggaaagggatggtggttcatgttttttaaaaaaagtctgcacatgaccctggtttttcttatgtttttctttttcatatcaagcagcacggaagccgaagtgtatgcggctgatcggaaggcttcagacaaaaacaaagtaagggtgtggttcagttctgaaaaagatccggcttcccgtacgtggtatgacgggccgctggaagtgaaatacgccttagacgaacaaacaccgcttacatggacaaaaaagaaggcttctgactccgccgccgtgtatattgatccgtcgcgccgctatcaaagtgtgttgggcgtaggatcgtccctggaagaatccacaatccataatttatcaaaaatgacacccgcaaaaagaaaagaagtgctgaaaaaactggttgatcccaaagatggtatcggcatggacgttatgcgcataacgatcgggacatctgattttacggcacaggaattttatacgtatgacgatatgcctgaaggccaaacagatcctaagctccgtcatttctcgatccaaaaggatattgatttacacattacagcaaccatcaaggaagcgctggcgataaatccggaactgaaaatcattgcctcaccgtggagcccgccggcttggatgaaaacgaatgaaaacctcaagcggggaaagctgaaagataaatatatcggcgcactggccgtttacttccgcaaatttattgaggcgtacgaaaagcagggaattccgatttatgcgatgacccttcaaaatgaacctttgctggaaatcgactatccgagcatgtacatgccgccgtctcaggagcgcaaactggcgatagccgtgaaaaaagaattgaaaaaacacataattgacacgaaaatttggatttatgatcacaatgcgagcggggcgtggaactatattccgccgattttagatgataaaaaaggaaaccgggcggcagacggcatcgcttttcacgattatgacggtgacctttccgtcatgtcggaaatcggaaagagatatcctgatcaatctattcacttaacggagcggtctgtctgggggacggcaggggcggatcggatcgcacagtatttccgcaacggcgcgtcgagctacaatgcgtgggtgacgatgctcgacagtcaaattaagacgcatcattggataggcaccccggacccgacgctgtttattcaggatgctaaaaaccctgaccgctattggaatatcccgatctttcatatgacaggcaacttttcaaaatttatcgagcgcggagccaaacggatagaaagtaattacggctccaaaaacacagtctcgaatgtatcgttccttaatcctgatcaatccattgtgacagtcgtaatcaaccagacatcttcagaacaaaaattccatgtcgtttcagaaaatcggcagtttgaagccgtcatcccggctaaaaccgtcgccacctacaaatggcagcacaaaaagtaaaaaagccggcacatcgatgtgccggcttttttctgttaagcgcctttttggttcagtttatcagagggcgctttattgaataaaccgtctttgacggcgtttgaagacgctttttttacaaaaaacgggttaaggataataacggcagccatgttagcggtcaacccccaaaacccttcatatataccgtgggcggattgggtgatatttaccgtgaatgtcacgataagaccgacgagaagaccgataattgtcgcttctttcgtttgattcttccaaaacagactgacggcgatagccggaaagatctgaaccatgccggaaacaccgagaagctgaagggtaacgagcgcagtcgggaacagcataccgaataaaagcgcgagcccgatgacgacaaataccattgaacgggtgatcatcgtcagcttgcttggtgacacattcgggtgaatcaaatcccgatataagttattcgcaaataagtttgatgctccgatggccatgatagagcagggaatcaatgacgcaagggcgatcgtggagtaagcaaatccctgtgcgactccgccgtaagacgtttgaatcagcttcaataaagcgagccgcggattggtatcttccggaaggacaagaaacgcgataaagccgagaaaaataacaagaatcaaaacaatattataaagcggcagaaacatgctgtttttgcggacggcatctgcgctttttgccgtaaatacaccggttgccgcatgcgcccacataaagagcgccagcgcagatacgatggaagctgtgataaaccaaggaattcctttcggccccgagtccggtatcgtcagcatttgcggcgctttttcagccaaagtgtgaatcatcggcgtccagccgtgaaaatggatcagcgggagtgagacgaccataaacagcataatcacccacaccagaatgtctttaataatcgccgtaaacgtcggccctttaattccgctgaaaaaagtatacagcgctacaagaataaaagagatgatgacgaccatattgacattaatgacacccgttccggccacctgaagcgtatcttgaatcccgctcagctggagacaaatataaggaatgagcataagaacgccgacaatggcgacaagactggccaaaagtttactgtcaaaacgctcacgggcataatcggcaagcgtcgttaatttgtgaatttttgccactttccacaatttcggcagaaagaaataagcgataaaatacgccaaaacagaatacgggattgcaaaaaaagcaacgcttccccctgtgtaggctgtgcttgttaagcctaaaaacgtataagccgtatagagatccgcgccgactaaaaaccagacgaggagccccccgaaccgtctgccgccgacagaccattcctcaacagaagtacgtgatgatttgtctcttccggctataaagccgatacagacaacggttaaaacgatgacggctgtaatgatcaatgctgttatatttgcgggcatcagtccagtcctccttgtttcttctgcagcctataaataagaaacgaacataatggagtgactgcgatccataaaagcagccagaaatgaaaaaagggcagcccgataatgatcggatgaacccgattagcgactgacagcagggccagctggctgaaagggattaagatgagaacgaaaattagtgcttttctgaccatttactttcctcctgaaacttgataatgctccttatcatagcaggtgtcagataagatcacaagatatttttcagaaaaaaaagaattctattacttttttaactgaaacactttagttgcatcttcattcatattaaattagaatagttaatatctcgaaatcaagatatttaggagtgaatacattgaatacacaaggattgcaccatgttaccgcatttgcaaaagatcctgctgaaaatcttcggttttatactgaagtgctgggtttgcggctcgttaaaaaaaccgttaattttgacgacccggccacttatcacttttatttcggcaaccaaaacggagagccgggcacgatcattacattttttccttttcagggaagccgcccgggaaccgtgggaaaagggcaggccggaagaatttatttctccgtgccgaaaggagcactcgcgttttggaagcgccggcttgaagaaaacggcttgtctgtaaaagaacagatcatgctgtctgaacaagtccttctctttaatgatacagaagacctgccgcttgccataatggaagatgaaagaagcggacagagtgaatggactccttcgggcattactgaaaaagaagcgatcacaggcatgagaggtgttcttctgtactcgtaccgtcctgaagcaaccattcaatttctcatagaacgcttcggttattcaaagacaggagaagaaaatcaaattgtcaggctgcaatcggaggcaaggatcggacatattatagatgttgaccttgcgccgaaagaagcaggtgccggcggttacgggacagttcatcatgtcgctttccgcacgagcgaaaaagagcaggcggagtggaaggatattcttgctgattctcatcttgcttcatctgacattcttgacaggtcatactttacttcaatctatttcagagaaagcggcggcattttatttgaaatggcaactgacgaaccgggctttatgacggatgaatcctttgaaaatctcggaacagagctgaagcttccggaatggctggaagagcatcgcagtcagattacagctgttctgcccataatggagaaaggagaatgatgatgaaacatgtgtttgaacagggaacgtcagaaaatgttctgctgcttttgcacggaacgggaggaaatgaacatgatcttctgtcgctcggacgttttatcgatccgaacgcaagtctgctgggggtcagaggatcagtgtcggaaaacggcatgccccgtttttttaagcggctgaaagaaggggtatttgacgagaaagatttaattgaacggacggaagaattaaagaattttattgatgaagcggcgcaaatgtacgggttcagcagagaaaacgtgattgctgccggctattcaaacggcgccaatattgcagcaagtcttttgtttcattataaagatgtactgaaaggagcggttctgcatcatccgatggtgccgatacgcggagtgaagctgcctgatatggaagggctgcctgtgtttatcggtgcgggaaaacgcgatcccctatgtacaaaagaagaatcggaggagctttatcagtatctgacagatgctcatgcatccgttgctcttgaatggcaggagggcggtcatcagctcacacagcaggaagccgagcaggcacgagcctggtacagtgagcgattcctataaaaaacccttagtctgcttaagcggactaagggtttctttcatcttacagccaagttgacactttagatacaggcagccggttgcttttatgcgccggcttaacggctttaccgattgaaatcagcatgacgggcacgaaacgctcgctcacgtcgaattctttaacgaattgctctttattgaatccgccgatcgcgcaagtgtcgtagccttttgctttagcggcaagcatcagctgcatcgctgctaaagaagcgtttaaaaatgctgaatcgcgggcaaactgatcattttggtatgcaccgttaatctggcctaaaagcgtttgtttaatctcttctgtgatattgccttgctcagccagttcagcataaacgtcttcaccattttcatttgcttttaagtcgcctaatacggcaataactgctgatgaatcaataatctgtttttgattaaaagcaaccggaagcagggcagcttttgcttcatcactgtgaaaaacttgaaaatgccaatgctgaaggttccaggcggaaggcgcttgcgttgtgatttcaaggagttctgtcaattcctcttttgtaatgaccgcgtctttatcgtattctttaacagatgcgcgttcctttaaaacgtctaatacggatgtcatcatgtttcctccttcggataaacgtgttatcataatagaaaagttagaagcttactaaatgtaacttgaaaactaattttaatggatcacaaaaaacttgtcaattcatagatgaagggatgaattcacgtgggatatacaatgtgtcctaaaatggaatccgctttttctcttttgggaaaacgctggaacggcctcattatccatgtactgatggacgggccgaaacgatttaaagatatgaccgaaacgataccgacaatcagtcaaaaaatgctcgcggagcggctcaaagagctggaacaaaatgaaatcgtcgagcgtcaggtgctgccagaaacacctgtcaaagtcatttataaactgactgataaaggcatggcactgcaagccgtttttcaggaaatgcaaaaatgggcagacagtttttgcgagcccgggggatctgccaacgacacatgtgatgaataataaaggctgcccaaggcagccttttcttaatgataatgtttaatcgtcataaaaaccattaatatcaaaattgttcagattgaggttcaagccttttaattgatttaataaagcatcgaatgtaaggaaatgatcatttttacattccgccggaacatcatctggagaaaatagttccattcctccctcaatccactgtttccggtataactgaaatgccgcttcaattaaatgatcaggcgttacaataaaccctaagcttacgtcatggtcctcactgtagccgaattcaaacccgcagcaagggcagatatcaaatgttttttgatattcgccgttataaacgggacttgtctctaatcctttaaatccgcatatcaaacaaggatacaactcactaaccaacatccatccctcttttattcagtttgaaaacatccaaaacaagcagggaggccttttacagtttcccggttaaaaactgagcctcaccgagcccgaagctccaatcggcgttcccgttttctgtaacggaaatcatgacgtcctcgggtgatatgccgcattctgttttaagctgatcagccatcagttgatataacgtttctttctgatgttcggtgcgcgctttgctgacaatgctgatgatgacaagagctttgcttcttttgaaaccgagcccggtatcttcaatgataagctcatgaggccgatgctggtgaacgatctgataacggtccgttactgggacgtcaaaagctttaaccatggcgtaatgggcggtatccagtaacttttttaatgctgcgtcatcccggccttcaataacgtcaaaacgaagtaatggcatattttattcccctgatggttttataatatcgtaacttgtaaaaaaagtataacagttaatcaaaatataatcaaattataaccaaaatgtttacatattaatgcaatattaaagagaggcacatgttgttacaatcgcccaatcaatttcctcattttatgaatacgcttaagaataggcagacataaaggaggaaaaacatgtaccctcgtcatgcattgtatcgcgggaatttcggtcctgccggatttccggcgagaagtccttttttgttcggcgctcctttattcggcggatttttaggcggtcttctcggaggcgtgattgccacaggttttacaagaccccgctatccgtacgggtttgccggttacggatacggaggcgtcccatacggcggtttcgggccgggagccggcggttatccgccattttattaagaaaaaacggcctgcatcgcgcgggccgtttttttatcttaaaatctccacttccgatagattgtagtcttcctgttttgaaaacataacttcaatcatcccgtctttatagactgcttttgttcctttccgtttgacgaggctcggaagtacgatttctttttttccttctcccaggctgctgttctctacaacgaggctgtgtgacgtatgcttaatcctgatacggtcgagttcctcttgttcggcgggaattttcgcaaaaacatgatcggatgtttcaaacaggtcaatttccggcttgggcggttccgcttcgaccggatcggcctttttggacatcgggtcgcgaaaagggaactgtccggcataaccggcgccgaatacgctttccatcactcggttgacatatgtctcgacatctttcggatcagcatttttaaacgtttctttagagaactgattttggaagggaaaatatctgttccaatcaaacacggcatctcaccctttcttaacggacaacatagtatatgcccgccggaagcttcccgtgatataatataatctgtttacagaaaggaaggggaaggccgtgcaagggaataacgtaagaaaaggaatcatttataccgcttgttctttcgtcatgtgggggctgtttccggtctattggaaacttcttgaacaaatacccgcattggacattttagctcaccggattttatggtcatttgttttcatgtgtgtgcttttaactgtgcttaagaagtggaaaaccggatggcgtgaactgcgtcttttgaaatcggaaggggcctgctggcgctttttttcgcttccgttttaatttccgttaattggtttgtgtacatatgggccgtcaatcacggctttttgcttgaagcaagtctcgggtactacattaatccgctcgtttccgttcttttgggcatcctattcttaaaagaaaagcttaacaagatgcaaacagcagccgtttctattgccggggcggccgtgctcatatctgcgtttcaatatggcgcggttccttatatcgcattgctgcttgcattcagcttcggtctgtacggcttatgtaaaaaaagaacccgcatgtccagcacgatcggactgacgctggagacgcttttgattaccccggctgcacttatttatttaggatatacagctgacgggagcacttttgggtccttggggcaggaacatgggcgctcctatttttcgcaggcgtatttacggccctgccgctgttattgtttgcagagggggcaaagcgtctgccgctgtatcaagtcggcattttgcaatatatagcgccgaccatcacccttatgcttggcgtatttgtgtatcatgaaccgttttccgggcaaaaagcgtttaccttcatttgtatatgggcagcattgcttttgtttaccttttcacagataaaatggaagcggccgataaaaagccgctaagcctttcgctttccagcgatagcttaaattatgtataatcattacgagtatgtaaaggagctgtacaatgggcactgataaagacatagcaaaagcctatcaggcactgtggaataaccgcactctcccggcttcaacccttgaagaagcggaaaaggcgattgatcttgaactgcttgatcaaagaacacatccgaggctccggaagtcacccgaggaaaagtttgctctggcggtgcagcgaattgtagattcccggctgcggccgattgagaaatatgaattggttgaactacatacgaagcgtttgcaatttttaaaagaagaaagaggggagcagctatgaaagcgatcataaaagaagatgtgcaaacttctttagagcgatatgccgatcgtcctgtatatatccatttggaaacaacgaccggttcttattcagcgcatctgaatgagaaaaatatgacggttgtagcctatatacgcaatgcaaaagtgacgtaccatcaggcgaaaatcaaaggaaacggcccgtaccgcgtcggtttgaaaacagaagagggctggatttacgcagaaggtttgactgagtatacagtagatgaagaagaccgtttgttaatggcggggcatctgccgggcggaaaattggcgatttcgcttcaaatcagcgaaaagccgtttacagtttaaagaaaagggtgaaaatcatgaaagaacatgtactcgtcatcctgcctcaccctgatgatgaatcatacggagtggcaggactgattgctttacacagacaaaaagatattcccgttacgtatgcatgcgcaacgcttggcgaaatgggccggaacatgggagatccctttttcgcgaaccgtgaaacactgccgctgttaagaaagcaagagctgattgacgcatgcaaagcaatggacattactgacctgagaatgctcgggcttcgtgataaaacacttgaatttgaagatgacgagtggctcgcggatatgatggaagagattatcgacgatgtaaaaccgagtctgattgtcacattctatccggagcacggcgtccatccggatcatgatgcatgcggcgaagcggtcatcagagcgctttacagaaagaaaaaagaggaccgcccgcgcacgctttgcatggcaatcacccgcaacagggaggaagccgtcggcaagcctgatgtcattcttgatattaaagaggttgccgatattaaaatgaatgccttaaaagcgcaccgcacccaaacggaaggcatgctgagagagctggaagaaaaattaaaaaataacgagccggttcttcagacatggtttgaagaagaagtgtattggacatatccgtggaaagactgataaaaaaagggataaggctgaaatgccttatccctttttttgtgtcagatcggaagcgatcgcttccgcaagcgaagaccgtattgataaatttgaaaaactcagtccgagctgcaccgcggtttgggcgatttcaggacggattccggataacgtcgctttcacgccgagcattccgagtgattcaattaaggtgaaaagctgttgggcaaccatcgtatcaatcatggctacgcctgataaatcaatgtacagctgcgtgatgcgcttctctgaacactggtgcagcgtattctccaaaatcattttggctcttgccgtgtcaatatccccgatcagcggcagcagtccgacattgtcaaaaagcacaattaccggcgagctcagctctgtaatcaattctttttgcgcttcaagctgaatgtttgtgtttttatacatttcctctatgaaaatatgaatgaccacatcaaacgatttaatcagcgtatggaatatatcttcggcatcttcttctgtcacggtgtctgaatgaagtctggtaaactgctttacatggccgacatacaaatcacgaactctgataaactcgcgaatgatgtaatggatgggagtttttaaatgttctttatcccgtgcggcttcaaacgcccacttttccaatgccgctgtatatacttccttctcttcagaaaaaatccgattgagttgataattaaacgccagattttgttttttcagatttgtgagaacagccgggtcagtagaagcataaacagaatcaggatccgtatcatgaagggtatcaaaccatgtctgactgatatcctccgcccgttcggttaaataatcgtacagcagtttatgtttcggcattgctgctcctcctttataaaatcatcatttttttcacataacgcttttgcagcttcatcagtctgaagaataaaccgacagctcctgcggcaagtcctgcaattaacccgatccagtagccgtatgccccgaggctcgtgtaagtgccgactgcgtaaccgagcggaagcccgataatccaatacgaaacaaaagccgcaccgagtgtatagttgacatccttatatcctctcagggcgccttgtatcggagctgctacggcatcagaaagctggaaaaacagcgcatagattaaaaagtgctgcgtcaacatgagcacctccggatctgatgtatacattccggcgatttgcggcctgaacagtaaaatgaaagccgccgtgcataaagaaaaacaaagggccatcacaatgccgatatagctgtatgaccgggcatccctgtaacgctttgcgcctgcttcaaagccgactaaaatcgtcatggccatggatacgctgagcggcagcatatacaagagggaagcaaaattcattgccgcctggtgggatgcaatcgtcaccgtccggaaatggctcattagaagtgtgacagccgcaaaaatgctcgtttcaaaaaataccgcaaaaccgataggcaaaccgattttcaaaagttttctgcattcagacggagaaaaacggtacagtttccgaaatacagagtacccggcaaacggctcaaatctgaagacgataaaaaagctgacggcgcaaatacaccagtaagtcagggcggaagcgagccccgcaccgactccgcccaatgccggcatgttgaatttcccgaaaataaatacataatttaaaacaaaattaataggcaatgagcaaagcgtaataagcatcgtgactcgcgttttgccgagtgcgtcaatgaacgagcgcaaaacggcgtacacaaacaaaggaaaaataccgagggataaaaagcctaaaaagtgtttggcgatcgtccggacacgaggttccaggcccaaatgtcccaagatcatatcaacggtgaaaaagccgaccaggataaccgccgcactgagaatggccgctacataaacggcctggatgacggaaaacggcacttccttttgtctgccggctccaaacagctgcgaaacaacgggcgtaacggccattaatattcctgcaaggcccgtatacaccggcgtccacaggcttgaaccgattgcaacaccggctaaatcggcggcgctcactttccctgacatcaccgtgtccaaaaaggtgatcagggcaaggcccgcctgtgtgattaaaatcggaatgaagatatgtaacagctgtctgaccttttggccgatcgtgttcgtttctctcaatttaggttccccgtttctttattttaacgagagaaattataacattttatgtataaaaagcaatgaaagccggcctactcttttttatccggtttcggctttttaaacatcttggcataaatgaatgaaagtgaaatgacccctaaaaaggtgcagatatattgcatcagccgtgcaaattccatatgatttcgcctcctttcatgattatggtgtacacagcggcgcatatccatgcgcgcgatgcagaaaataagggaaaggagatgatgtgacatgcgccacactcaaatgacggaaagcgcgtttaccgctgccgttcaaacgtacttgaaacaaattaccgaggatgccggaatgatactgcggacattggatgaaaaagaccaatgccttctttgcgaattagatgaactgggacatacgtttcaggaaatgcaggctgtcgcttcgtcgttttacctgcagtcatatatcgaacattttacgccttcctatacagagctggcgagggccgtgcagcatctggcggaagaaaagcacggagcgctgattgtgattgaacgtgcagatccgctggacggaatgatacaaaaagggaccagcctgcatgccgagatcagttcagctttaattgagagtattttttatcccggcaatccgcttcatgacggagccgtattggtcagagaaaaccgggttgtatcagcagccaatgtgcttccgctcacaacaaaacatgtcgatctcaaatacgggacgcgccacagggccgcgatgggactttcggccgtgactgatgcactcgtgctcgttgtttcagaagaaacgggaaaaatgtcttttgctaaagacggcggactgtatccgcttgtttcgccgcgggcgcttcatacgaaataataagaaaatgggaatattgtacccatttaatattaataaggtgaacatctttacctttttctgtattggtgttatcgtttaaatatacataaaatttaaaagaatagggagtggaaagatggcaaatgtattgatgatcggctttccgggagaaggccatatcaatccgtctttaggcgtcgtaaaagaactgaaggcaaaaggggaacatgtcgtatattacggcgtgaaggaatatgagcacaaaatcgcgtcaagcggagcggaattccgtgaatgtgaagatttccgaaaagatgaattcggaaaaaacgcaacgggtgatgaacagcgggatgctaccgagtttttactgttaatgattgagacttccgaaaaagccgcactccgtattcttgaggaagtaaaagatgaatcatacgactacatcctttatgatcatcattttctggcaggaaggcttgtgagaaataagctgaaactgccggcatattcactttgcacaacatttgcaatgaatgaagcatttattaaagaagtgttttcaaatacaaaccttatatcagaggaatcatctcattatccggcttataccgaagcggtcagccggcttaatgaagaattcagcgcagacattaaaacgccgtatgatattttctcaaatgacggcagaaaaaccatcgtatttacttcaagagcgtttcagccgaaagaagaagagtttggcgattcttatctctttgtcggtccgtccataactgaaaggccggcggctcaggatttcccgtttgaccagcttgaaggagaaaaagtcctgtttatttcaatgggcacgatttttaacaatcagaaggaattgtttaataaatgcttaaaagcggtcaggaactttaacggaaaagccgtcatgtcaatcggcaaacatcttgatccggcggagcttgatgaaattcctgagaatgttattgtaaagccttatgttccgcagcttgagatcctgaagagagcggacttatttatcactcacggcggaatgaacagtacgagcgaagggctttactacaaaaccccgatgatcgtcattccgatgggagcagatcagttcgccgtcggaagccaagtggaaaacacgggcgcgggcaagatgtttaaaaaagaagatgtaacagcggaactgctcactgaagcaataaaagaattgagcgaaaatcctgaatatcagacaaaagcttctgaaatcggagaatccctgaaagcggccggcggagcacagcgtgcagcggaattgatagcagaagacgtgaaaactgccgagacccgggttctgtaatcagccgtcacccgcttcctttataggaagcgggcttttttttgtttgtttttcgggaggattttcacgccgtgaagagaattgtatgaaaaacagacaagaaaggtggaatgtcgcggaaaaaagccatgttatgaaaatgattccaaagtcttttgtgaaatgttctcaatttatgtaaaatgtgtggcattggtgatgatctaagaccaaatgaatcggaattaatgtcgacttctgaatgaatcctgcataacaggcggcgtccaaagaaaaggaacgtccctttcagcaatgataaataggaggtttttcgttatatgaagaaaaaaatcgcagccggactggctgtatctgcagtaatgacttcaaccttcgccgtgcatcccgctgaagcaaaaaccattcaagtaaaaagcggcgactctctttggaagctttcccggcaatatcatacaagtatttcagccctgcaggcggaaaataaactgaaatcaacgatactccacccaggacagcggctgcacattcccgacgggagcggcacacataaaacggggcaaaaaggaaaacgaaacactggtgcttacacagttacatacggagactcattatgggtgatcgctaaaaaataccgaatgagcgtttctgaactgagaagcctgaaccgtttgagttcagatatcatctatccgggccaaaaactgaaaattaaagggtctgccggcggcacggacggaggcggcagacagacaaagcctgataaaggcgcatcagggacttacactgtgaagccgggtgactcgctgtggaaaatcgccaatcaaaccggcatcaccatcgccgaactgaaaaagctgaatcaattaacatcagacatgctgtatccgaatcaagtattaaagatcaaaggttcttcacataacggaaacagcggcacaacaccgccatctcattcaaacccttctgagaagccatccacttacaaagtaaaagcaggcgattccctctggaaaattgctaatcggttcggcatcaccgctcagctcatcagagaaaaaaataaactgacaactgatgtgcttcaaatcggacaggttctgttgattaacggaacgggaaaaacagaagatcctgtgcggcagccgggtaacaaaccggcaaagccaaacaagccaaatactcccgaacctccggtgacagggtcaaagattgacagaatgataggcgaggcgaaaaaacatgtcggcgtgccttaccgctggggaggcaatacgcctgcgggcttcgattgcagcggttacatctattaccttttaaataaggtaagctctgtttcccgtctgagcacggccggatattggaatacgatgaaacatatcagccagccgtcagcaggcgactttgtcttctttacgacatataaagcgggcccttctcatatgggaatgtatttaggcggaggagattttattcacgcaagctcctccggggttgaaatttcaaacttaagcaatccatattggaaaaaagcttatttaggagcgcgcagttatttttaaaaaaaagcctttcggggctttttttgtttaccattttcacgttttgacaagactgatgggtaaaaaaataagggggaggaagcatgaatcgtctcttgctttttctcatgctcgcatcaattacgctttgcggctgcggggcgagacccgctcctgctccgcccaaaaaacatggggaaagccgcgcattggaagcatctgcataccgtgagcatgccggactcatcaatcaaaacggaaaaacgatcggatatatcgaagtgagggaatctgatgatgaaggatcagacattcatatatcagcgggacatctgccgcccggcgcttctctcggatttcatatttatgaaaaagggacatgtcaggcacctgatttcgaatcagccggcggtccgttcaaccctttgaacaaagaacacggcttcaacaatccgatgggtcatcacgccggagatctccccaatcttgaagtgggggctgacggtaaagtggatgtcattatgaacgcgccgcaaacttcattaaaagaagggagcagactcagcctgctcgaccgggacggaagcgcgttcgtcattcatgaacatacggacgattatttaacaaacccgagcggaaattccggagccagaatcgcctgcgctcccctgacaaaaagcgcccgcagggaatgagcccttttgtattgagtatacaagggcttttttagtatactcggttatggaatacaaatggaaaggaaacatcacctatgacttcagaattacagcacctatcacttccggaagatatacaaaacaaactgcaggcttatcaaaatcatcccgtttcccaagaattccgggatttaatcggatcatcaggctatgaggccgaagataaagcgattgtattcgatgccgtcatcgctttgacaatgggaaaaaatatcttattaaaaggaccgacgggttcgggaaaaacaaaattggcggaaacgctttcgaactattttcataaaccgatgcacagcgtcaactgctccgtagacctcgatgcagaagcgcttgtcggctataaaacgattgaaaatgaacaggggcaggcgacaattgaattcgttcccggacctgtaacaaccgcaatgaacgagggacattttttatacattgatgaaatcaatatggcaaagcctgaaacccttccgattctaaacggcgtgcttgattacagaaaaatgatgacaaatccctttacaggagaagtgattaaggcaagcgaaggattcggtgttatcgccgcgattaatgaaggctacgtcggcaccgttccgctgaacgaagcccttaaaaaccgttttgtcatcattgatgttccgtatattaaaggaagcctcctgaaacaggtgctgacctctcagtctgtcttaaaagatgagaaattaattgagcgctttatgacgctgtcttctgatttaatcgcacaagcgcataacggacaagtgtcagaagaagcggcgtccatcagggctctcatagatacgtgcgacttggctgcgtacatcccgccgaaacgggcgattgaaagaggcatcgtggaaaaacttgacgacgacagggaaaaagccgctgtcagaaatattgcagaaacgctgttcgaatgagggatatacaatgaagtttatcaaatttaacgacagcacgattgattcgtttttgttcatgatgctgactgatctggccaaaacactgaccagaagcagtgaagttgaagtggaatacggcgtgcagtcttactacaatccctttgaaaagaaaatttacatgagccacttttggaaagaccgatcagccggggatatggaagccggcctgaaaagcgatgtctatttgcgcgctgtcggaacacgcagcagctcatttcgggtatttgcggggtttttaaatgacgttcaccggcacttcacccgccaaagctttgccaagcagctgtttatgctgcttgaggatatcagaattgaagagcagatcaaaaaagaacggccgggaacgaaacgtgtttttcagaagcggagggagatgtacaggaaatatttcacgacgcagctgacattgaatttagaacggagcattttcaccgacgctttgtattgcgcgatgtttgtcaagctgacggctgagtctccgcttgaaggcattccttccatgcatgaaaatattgatatgatgataccgtatattgaacgtcagctcatccgggtgtatgaggcggattctacggaacaaatcgcaacaataacggaagacctcatggaaggccttgatgaagtgcttgagaaagatatgctgaacacatacttttttctgccggaacttgattacgaaaaagcggctgaagagcctttattcgaaagcgtaaaaaaagcgccttcgttaagtgacgatctcacgctccctgagtcttccgacggagatgaagaaatccttgaagagaaaatgaatacgtggcaccgggaaaccgaagcgccgtcaaaaagcttccttcaatttgatattgagcacggcgcgaaatcagatcttgggaaagacgcggccagagaaggcgatgacggtgaccaggcgctcggctccgttcaaggttccgcacgtcagacgaaaagagaggattactctaaactggaagcgcttgaatccattcaggatgaacatgagggcgccgggctggctgacggaaaagaaaacaaatttgccttcccggtttatcaaacgcctcaaaaagcgtctcctgaagaggagcagtcttataaagaacaggcaaaaacgatagaatcatatcaaaaacgcctgaagcagatgatacaaaaaacacttgagcacaaaaaaacgctcccgcggaccgaccttcacgcaggccggctgaatcgcaaactgatccgctattttacggaacggaacccgcgccttttctataaaaagcaggacccgtcttcagacattgacgccgtttttacattgcttgtcgattgttcggccagcatgtttgacaaaatggatgaaacaaaaagagggatcgttctttttcatgaagccttgaaatcagtgtccgtccctcaccaaatcgtcggattttgggaggatacaaacgaagcgaccgaaacgagccagccgaatttcttcaataccgtcattccgttcgaagagtcgctgctgcaggctgcgggtccgctgatcatgcagcttgcgcctgaagaagataacagagacggatacgccatcagacaaatgacgaaacagctgatgcggcggagtgaggcgcaaaaatttttaatcgtgttttcagacggagagccggcagcattcggatacgaacaaaacggcatcgtcgatacgagcgaggctgtcatcgaagcgagaaaaaaagggatagaagtcataaatgtttttctgtccaatactgcgatagaagaatcccagatgaaaaccattcaggatatgtacggaaagtacagtatttttgttccggatgtcgatcagctgcccgatgtgctgtatccgcttttgaaaaaactgcttcataaaagcataggataggctttttcctatgctttttcgctttttattttaaaatgatttaattttttcggtattgatctgttttttttactattttgtgaacaatcaaggtagaatccaaacgcaatcagtggtaaaatatccttggaagcgtttttattacataattttgggcacagcgttcaaaagttatttcaagatagtgaattgatcacttgattatctaggttgggggtaatattcaaatgtttcaaaataatatgaaacaaagaatgaattgggaagatttttacggaccgaacctcggctacgcactggagctgtacgaccaatatgctgaagatccagacagcattgatccggatctgaaagacatgtttgacgaactaggcgctccgccaagccaaataaaagaggcatcggaaacaaaggaacagggacgcgtcaccgcagatctgattcaaaagatcgcagcagcagttaaacttgcagaagatattcgaacctatggccatctgaacgcttccgtcaatccgctcagaaaggatccgaaaaagagcgagctctttccgttatccgagtacgggcttacagaagaagaaatgaaagcaatacccgcgtctgtcatctgtaaagacgcacctgccaatataacaaacggcttagaagccatccagcatttacgcaatacctataaaagaaccatctctttcgagtttgaccatgtgcatgatttcgaagagcgcgcatggattacaaaaatggtcgaatccggcgaactgttccggaaaaattcaccggaaaaactgtcagccgttttagaaagactgacggaagtagaaggatttgaacaatttttacaccggacattcgtcggtcagaagcgtttctcaattgagggattagacgcgcttgtgccggttcttgacgacattatcgcccagtctgtgaaggcgggcacaaccaatgtcaatatcgggatggcgcacagaggccgtttaaatgtgcttgcgcatgtgctcggcaaaccgtatgagattattttctcagaattccagcacgcgccgaataaagaccttgtgccgtctgaaggatcgaccggcatcagctacggctggacgggcgatgttaaataccacctcggtgcagacagacagcttcaggatgctgaaaccaaaagcgcgcggattacgcttgcaaataacccgagccacttggaattcatcaatccgattgtggaaggaagcacgcgggcggcacaggaaacaagaacgcaaaaggggtacccggttcaagacgaaacaaaatcgctcgccattttaattcacggtgacgcagcgttcccgggagaaggcattgtcgccgagacgctgaacttaagctcactgaaaggctatcaggtgggcggggccattcatatcatcgccaataatatgatcggctttacaactgaaagcgatgaatcacgatccacaaaatatgccagtgatttggcgaagggctatgaaattccgatcgttcacgtcaacgcggatgatccggaagcatgcctgtcagccgttaaatttgcggttgaataccggaagcggttcaataaagatttcttaatcgatttaatcgggtacagacgatacggccacaatgaaatggatgagccgtcaacgacacagccgatgctgtatgatgccgtcagaaaacacccgactgtcaagcggatctttgcggaaaaactcgtaagtgaaggactgatcagcgaggaaaaagcgcaaaacatcgaaatggcagtgacaaaacgaattgaagacgcctataaaaaggtgcccgccaaaaaagaagacgccgtacgggaaattgaattgccggagccggtgtccaacggttttccagacgttgacacagccattgattttgatgttctccgcaagctgaatggcgaacttatcaactggccggaatcctttaacgtgttcggcaaactgaaaagaatcctggaaagacgtgcaaaagcgtttgatgatgaccgtaaagttgaatggtcattggctgaatcgcttgcgtttgcttccattttgaaagacggcacgccgatccggctgaccgggcaggattcagagcgcggaacgttcgctcaaagaaaccttgtgctgcatgacagcgaaacaggagaagaatttgttgctctccatcacttagacgactgcgcttcttcatttacggtgcataacagcccgctctctgaaggatcggttctcggctttgaatatggatacaacgtgtattcgcctgaaacgcttgtgttgtgggaggcgcagtacggggactttgccaatgcggctcaagtctattttgatcaattcatatctgcaggacgggcaaaatggggacaaaaatcagggctggtcatgctgctgcctcacggttacgaagggcagggccctgaacactccagcggccgcgtcgagcggttcctgcagctggcggcggaaaacaactggacagtggccaacctgacaagtgcggctcagtatttccacattttaagaagacaagcgaaaatgctgcttcgtgaggaaatccgcccgcttgtgatcatgacgccgaagagcttgctgcgcaacccgaatacggtatctgaagtgcaggaactgagcgaaagccgattcaagcctgtctatgagcagtccggtctttcccatgcttacgaaaaagtgactcgcgtcgtattatcaagcggaaaagtgtcaattgatatcagcgatcacttcaacaaaatggaaggcgataaggattggcttcatattgccagaatcgaacagctgtatccgttcccggcaaaagatacgaaggagcttttcgccaaactgccgaacctgcaagagatcgtttgggttcaggaagaaccgcagaacatgggggcatggagttatatcagcccgtatctgacggaaattgcgccaaaaggagtaaatgtccaatacatcggccgaagaagacgatccagtcccgcagaaggagatccgacagtccacaaaaaagaacaggaacgcattgtatctgatagcttgactcgcaaaaactaagggggaaatgtaaaaatggcggaaattaaggtacctgaattagcagaatcaatctcagaaggaacgatagcccaatggttaaagcagcccggtgattatgtagaacagggtgagtacttgcttgaactggagacggacaaagtaaatgttgaattgacagcagaagaatcgggtgttctaaaagaggtattgaaagattcgggtgataccgtccaagtaggagaaattatcggtaccattacagaaggcgctggcgaaagttctgcacccgccccttcagaaagtgctccagccaatgaacaaacgaaagaggaagcaaaagctgaacctgctgcacaagaagtcagccaggaagcacaatcagaagcgaaatccagaacggtagcgtctccggctgcacgcaagctggcaagggaaaaagggattgatctatcacaaattccgacgggggacccgctcggccgcgtgcgcaaacaagatgtggaagcttatgaaaaaccggcttcaaaacctgcggcacagccgaaacagcaggctcaaaaaacacagcaaagctttgacaaacctgtcgaagtgcaaaaaatgtcccgccgcagacagacgatcgcgaaacgattggttgaagtgcagcagacttctgcgatgctgactacatttaacgaagttgacatgacggccgttatgaatctaagaaaacgccgtaaagaccaattccttgagcaaaacgatgtaaaactcggtttcatgtcgttctttacaaaagccgtcgtggctgcattgaaaaaattcccgctccttaacgctgaaattcaaggcgatgagctgatcgtgaaaaaattctatgacatcggtatcgctgtcgcggctgaagaagggcttgtcgtcccagtcgtacgtgacgctgaccgcctgacgtttgccggcattgaaagagagatcggcgaacttgcgaagaaagcgcgaaacaataaattaacattaggtgagctgcaaggaggctccttcacgatcacaaacggaggtacattcggatcgcttatgtcaacaccgatcctaaacagccctcaggtcgggatcttaggtatgcacaaaattcagctgcgcccagtagcaattgatgcggagcgctctgaaaaccgtccgatgatgtacatcgctttatcatatgatcacagaattgtagatggtaaagaagcggtcgggttccttgtcaccattaaaaacctgcttgaagatccggaacagctgctgctggaaggataatttgaaacagacaaaaagtacactgcccttacaagcagtgtacttttttattgagcgaaggggagaatttatatgaaaagctgttatccgcttgagatcgaatttgaatataatgaagaattgcattctatcactccggttcttctgcaagacgaacatgacacgatattaatagactgcggatatcccggttttacaaaccatcttcaacatgctgctgcccggcatggaatgtcgcttcattcattgacaaaaatcattgtaacgcatcacgacatagaccatatcggctcactcgctgcattacatcgtttgcacccggatatcagcgtgacagtacatgagcgtgaagcgccgtatattgacggctctaaaaaatctttacggcttgagcaggctgaatcaacgtttagttcattgccagaggatgcaaagccttatgcaaaacagttcatttgctcgcttcaatcagtcgaatcggctccagttcaccggacagttactgacggtgagctgctgccttggtgcggaggcattcgcgttgtagccacgccgggtcatacacccggccatatcagtctttatctgcctgccgaaaaaacaatgatcacaggtgatgcggtcgtcattgaagacggaaagctgaaacttgctaatcctgactatacgttacatatggatgatgcggtccgatctgtgcagcggctgcttgattacgatatccgccaattgatttgttatcatggaggtttatttcagggggatgtaaaaaaagcgcttttgcgcctgtttcgtgatctgcagaataatcaaggataggagcggcggcagcctatccttgttcagttatgaaaacggaatctttgccgtttcttcttcggcgctgtttttctcttttttcttagaccagtaggtggcaagaacagaccccgacagattgtgccatatgctgaaaattgcgctcggcacggctgacaaaggggagaaatgcgctgtcgcaagcgctgcgcccagtccggagttttgcattccgacttctatcgcaatcgctttttgtgaagcataatccattctgaacagctttgcagtcaggaatcctaacaaatatccgattccgttatgtaagatgacgacagacacaatcagcagtccggattgaagcagatgctcacgatttacgctgacgacagaggatacaatcgctacgatgccgattaccgatacgagaggaagtgcgtgcacggcttgtccgacctgttttttgaagaacagcttcacaatcaccccgaggacgatcggcaaaagcacggcttgcataatggaaacaaacagtgaaccgaaagaaacgggaagccactctttcgcaaacagcataataagtgccggcgttacaataggagcaagcaatgttgagatcgtggtgaccgcaacagaaagcgccgtattgcctttcgccaaaaacgtcatgacatttgatgccgtaccgcccggacagcatccgaccagaatgacgcccgcggcgatttctgcggggaggcggagcccgactgataaacagaaagccgcaagcggcataatcgtaaactgggcagcgactccgatcacgacatgccaaggctttctgattaattctttaaaatcgtctgcttgaagagtaagccccatcccaaacataataataccaaggaaaatcgtcatataagaactgatccaagaaaacaaatcagggcaggcgaatcccaaaccggcaaagacgataacccacaagccaaaggtttggcccgcaaacccgcttatttttttcagccattccataaacacagctccttttacatccaatcaatcagtcagaaaatatgactgacttttctgtactccattataaataatattctgaataattcaatattaaatataagttttcgataaaattattatgtaaactaatatcttcttgactattcagacatatattcttacaattgatttttatactgaaatgaattgggagtgctgaagtgaaagaagctaatcaatggtcatctaagctgggatttattttagctacggccggctctgcaatcgggctcggcgcaatatggaagttcccttacgtagcgggaaccagcggaggcggcgcttttctgcttgtttttattttatttactgttttaatcggactgccgcttttgcttgctgaatttattatcggcagaaaaacacaaaaaaacgccgttgaatcctataaggcgctggcgccggggaaaaagtggcactggatcggatatctcggaatcataacgtgttttattctattatccttctacagcgtagtgggggatggatattaatctacattataaaaggctttacaggcggtttaacgctttcttcgggatttgatacgttatttatcgataccatttcaaacccttatgcagcggttttcggtcagctgctgtttatcgtgctgacgattttagttgtggcaaaaggggtgagcagcggcatcgaaaaggtaagccaggtgctgatgccggctctgtttattctgtttattcttttaatgatccgctccgttacgctgcatgatgcagcgaagggattaaaattcttcttcatgcctgattttggcgcgatggatgccaataccattttatatgcgatgggtcaatcatttttctcgttaagcgtcggagtgtccgtaatggttacatacagcgcatatttagaaaaagaagaaaatattgttcaatccgccgtatcggtgacggtattaaatgtccttgttgccgtgatggcgggagtggcgatttttccggcggtatttgcattcggtctcaagccggatcaaggtccgcagcttttatttaacgtgctgccgaccgtctttaaccaaatgccgttgggcatcgtgtttttactcgcctttttgctgctgtttttatttgcgacgctgacatcggctttttcaatgcttgaaattttagttgctgttttgtcaaaaggcgattcggcaaaacggaagcggtatgcatggatcgggggacttgctatatttattgtcggggtcccttcggcgctgtcgtacggcattttgagtgatgtttctatttttcaccgcagtatttttgacgctgcggattttctggtcagcaatgtcttaatgccgttgggcgcgcttttaattgccgtgttcgtaccgctgaaaattccgaaacagatgctgtttgacgaactgaaaagcggttccggtataaaacgaaaatggtttgcagtctggctcctattaatccgttatgtggctcctgtagccattattatcgtttttctgcacgtgcttggtattttttagaccaaaagaagcaggcccccgttcaagacgggggccttttttaataaagcggccacatcacgcggtgcgcttgctcgaaccgtttctccgcctcccgccaatcaacgacattccaccattgatccacgtaagccgcgcggtcgtttttatattgtaaataataggcgtgttcccatacatccagcggaagcaaaggaatgacgtcccattggctgtagagctgatgcttctcagcggccaaaatctccagccgcccggagcgcggcgcccagacaaggatagcccagccgactccttcgactttttttgctgcttgagaaaattgctctttaaaagcggaatagcttccgaatgacacatcaatcatttgaaagagcgcacccgtcggccgtctttttccgtttggattcatggaaaaccaaaaaatactgtgcaaataatggccggcaccgtgaaacgccaattgccgctcccaatgcgccactaagtcgtactgtttcgtttgtctcgcttttttgagctccagttctgctttattcagaccgtcaacatagctctgatggtgtttagtatggtggagtttcataatctctcttgaaatatacggttccagtgcggaataactgtatggcagtttagggaggacatgcttgccgatcggcacataggctctgcgctcatccggctcttccggttcggtaatgtcccggtaaagtgctgatgcctgttcgtaccattccgcctccgttaatccatcatcctgaagggtgtgaaaaatccggtcgatttgtgccgcgaagcgatcgaaccgaccttgctgtatgacttgttccttcaaggtttcacaccaattcagcatttcggtttgataagcgtgccgtttcatttttcttcctccttttcactcactttcataaaagtgctgagcgcaagcaaagaaaacacatacgggtagctgtgatacctgatgtaaaactgtttcggcaggccgattccggtcggatagctgaaagcgtctccttcgtaatgccggttttcaataagaaaagatatgccttttgtgacggcttgatgatgaggtttttcgtattgcagcaaagcttcggccgcccaagccgtctgtacaagcgtcccgtaagaaagcggaacataggttttgacttctgcgcttttacaggattctccccagcttccgtcctcgttttgaatggacttcagccagcggatcgcttttttcacggccgggtggttttggctcacgccgcaagccttcatccctgtcagcgctgcccatgtgccgtaaatatagcagacaccccatctgccgtaccacgatccgtcctcttcttgatggcggatcagccattggacggccttttcaatctgagggtgatcaggagaaagccccgcttctcctaaacagtgcagcacccgtccggttaagtcgcttgttgaaggatcgatggcagcttcctcagccgattccagcggcagcaggcggaccagcggatgattgacatttttctcaaaagcagagaagccgccgtcactgttttgcatggacaaaagccagctcagtccgcgttcccatgaggcgggataacgttttcgcgggatggctttgagcactgcggctgtgtcatcacaatcaggattatttgtattaatgtttgaaaaaccccatcctcccggttcagcatgcgggttgtgaacggcccaatcagcgactttcgtctgctgccgttcacgcagaaaccgggcggctccggttatcatttgatcgttatctgagatgccgcttttcataagcgcatagctgagaagcgccgtatcccaaacggtcgacgttgaattttccaggtacggtatatcgctgcaagacgtgagcaaagctttcgtgccggcaagcgcttttctgataacgggggagtggcgcgatacaccgagagcgagcaggccgtacaccataaaaatagtggcactcgcatagctgtataatgtgccgtcttcttcaatccggtcaagcatatacgttttggccgtacgcagaccgagctggtgaaaagcggcaggaatctgcaaaagccgcttccagtgcgcgaaaagagaagagaggtctctgttctcatcatgatcggaacgaagccatgtaaacggatttttagtcatatgccgatctaaatgcgcgagagacggaacattgggatttttcagcgaaaatcttttgttaagcgtcacggccatcggtacgaaatgaatacgagcgtatgtactgaactggtaaaaatgcagcgggaaggatgggggaatgactaagaaagataatggcagatgcagcgcgggccatgggtaaaggccgtttgccgcaagcatccactttgtcatgaagtgtacgttgcgcaagccgccatttgagatgataaagcgttcagcctgaatcatatgcgcctcagaacggctatataaaccggaagccagcaagccggcatagccctgtacagtagcggtcacatttcctttccggtcatcaggatagttggcaaaagttccgtccgggcgctgtttagcgcgaatgccttctgcaagctcagcgatcagttctttatcattgtctccaagagaagtgagaaggaggatcagaaaggcgtttgtcaaaatcggaccttcaaaacaaaatgaccatgagccgtccgcattttgcgtttctcttaatagggagatggttttcttttggcggcttctgacgttttcatgaattgtgctcacactcgctcaactccttcagaagcatatatattcatatgtaaaaggcggcatgacaaaagaaagaaactgctgacaggcagcagtttcttgtttgatttaatcttccaggttgatccagacgcttttcacttctgtataattattcagcgcgtaagagcccatttcccgcccgaggccggattgcttatagccgccgaaaggagatgccgcatcgaaaacattgtagcagttgacccaaacggtgccggcttggagacggtcagcaatgtaatgagcgtttttcacattttcagtccaaagtccggctgcaagaccgtattccgagcggttcgcccgctcaatgacttcatcaaccgtatcatacggaatggcggctaagaccgggccgaaaatttcttcttttgcgatggtcatgctgtcatccacatccgcaaatacagtcggggagacaaaatacccttcttcaaacgggcagctgccgcccgcgacagctttggctccttccgcttttcctttttcaatatatgaaagcacgcgctcatgctgttcctggctgacgagcgggccgatttgtgtatcttggtgaaggccggcgccttgctgaagcgatttcgcatatgaaaccatttcgctgacgacctcatcatatttgtctttgtgaatgaagacacgggagcctgcgcagcatacctgtccctgattaaacatgaccccgtttaaagcgccgggaatggctttcttcaaattggcatcaggcaaaatgatgttaggtgactttccgccaagctccagtgtcacgcgtttaattttttttgcggctttttccatgatttttttgccgatttctgtagaaccggtaaaagcgagtttatcgacatcgtcatggttggtcagcgcttccccggccgtctcgccgaaccctgggacaatattgatgacgccgtcagggaagcccgcctgatctattaattccgctaaatagagggcggtcagcggtgtctgctccgccggtttcaaaacgattgtgcagcctgtggcaagggcggcgcccattttccacatcgccataaggagcggaaagttccaagggatgatctgccccacgacgccgacaggctcatggcgggtgtaattaaaatatgagccggcgaccggaatcgtttgtccggttatctttgtagaccacccggcataataacgcatatgctcaattgcgagcgggatatccccattcgtcgtttcattaatcggttttccgttatcaagtgtttcaagctgcgcgagttccgttttgtgctcttccattaaatcggcaagcttatacatcagcctgcttctggaagcggccggcatagtgcgccattcgccgtgatcaaaggctttgcgtgccgctttcactgcactgtcaatgtcttctgtctgtgcctcgtaaagcgtcatcagcgtttctccggttgccggattcggtgtgacaaatgttgatcctgaagcgctcggaacaaattttccgtcaatataaagtttcttcgtaccctgtaaaaatgtttccagcctttttgtgatctgcatcgttaaagaactcattcgtaacaaacctcccgaaattttttatggtctgttttgagcatcttgatgtccgcgcaaagtaagcgcatacagtcattctataataacacccccggtaaaatcaatcgataaccgttattgcaattcacaagaaaaaacggctacaataagcttatcgattaagaaaaggagttttataaatgattcataataattggcagacaaaagaaagcgtcaaaaaggtcaaatgcgtacatacagatgcgaaaaaatacattgtcaaaaatgtgctgacgccgggtaaagagtatgaagtcaaaaatgaaacagaagaattcatttttgttgcagacaatacaaacaaagtcggaggcttctacaaagagtattttgaagaagtttaaggctgaatgaattcattttgcctgagccatactaaaaaagactacatataaagggtggctgcaaaatgaaaaaaacagagcaagacaaacaaaataaaacatcagatcagcttcagcaagtgcaacctgaagaaggcaccgacacgacgatggaacaaatttcagatacctataaagaaggaacaattgaagatacggatcgttgatgttttgttgaaaccgcggcattggagaagccgcggttttttatggcgaaaataaaaaactgacttttcgaaaaaaataccgttttcttgaaaccttttcttccgctgaaccgtattacttcataactgcggcacctttcgcgaagggcttttttgatgaacgttctaaaaatgtaatctgttcgtaatggtttaaatgccgtctatgtcgtattcttatatagggataaagaacttattttttatgattgtaataaaacaatagtatagaagcagaaagtggggttcttcattgggaattttttctgtcagcagatcaaccgacacaaaaaagctggaggctttgctcgttgagggagaacggatcgaaacgatttataaactgcgggttgaccaaatatgctttacgaataaacgagtgattttctttgataataaaatgttctccaaaaagaaagtgcgcgtatttcttccatataaaacaattgaaagcttcgccattcaagaagcggggatgtttgatcccgataccgggcttgtattaatgacaaggggaaaaactttcgaattggaatttgcaaaagaaacggacttgactgaggttcaagccatcttaacaaaatacttatgcagttaaatatcacataaaagccatccgaatgcatgcggatggcctttttattatataatgcttgtttttccggagttcgaatcaatgagatccgggtcagcgatagaactgatggggatataaatcggcgccaaatcaccattttcttcaccgaatccgtagttgatcttattggataaaaaataatcgatttgctgatacgggccgatcgtaatggaagaaccgcggtcgaccgcatttactttaaagcctcctacatttaccaaaaccggcgaaaacatcataatgggcctccttttccggcagggattttgtcgcatgcagactcaaaggttgatggagaatcaatttgatcccggtcatccactttgccgttcgtgccgatgaagccgcttgcatctccgaagttctgtccgtatccctgattctttttatcagaattctgccattccgccagtaaattttgtccgacattcaccgctgaagcattttcaaaggaattaattttcaacatgaaaatattaatattgatatatggagttggttgaaccacaggcaaacctcctttaatacaggtgtatgccggctgttatgaccgtatgcttagacagggggcgataaaaatggatttcgataagatgaagcaatggatggaaatggcgcaaaacatgtccggcggcgacttttggaaaaacgtttttgatgatgaacaactgaaatcatttcaaaacggccattctcattttccctttcaacagggagatgggcaaatgagaagaaatgaggatgcttttcctcttatagatattgtggaaacccatgatgagctccaatttttgctgtatctgcccggctaccggaaacaagatgttcagctgttgtcctacggagaatatattgtcgtaaaaggcacgagaaaatcctttttcaatgaacaggattttaaacagaagaccggaaaatacggcgattttgaaaaaaaactcgatcttccgcattccgctcaaggtacgaagggaatgcaggcggtattcaaagacgggattttatatatatcgattgctaaacatctgggggatgcaagccagatcattatcgaaggctgatcttgttcgctgtgccatctatcagatctgaatcatcgatactcatgatagggatggcgacaacggtgcaatcaccgttttgttcaccgtacccttcatttcttttattggctgctgtgtttctcaccataacggaagagccggtgttaaaagccgctccgccgctgattccgttcatttttatatactcaaagttgataacggatggaaaaaacatcatgattcgcctcctttttgtatatcatgtttatatattcgcaatacgggacgcatagaactttccaagagtgacggggaaagaagtgattttctttgaaaaaaataatgaaagagattttcaaaaaagtgtgtgaagaagaattagaccggcttaagaaagtggaacaacagcttgatgagcttcaggataagtgtcattttgagccgcaaacggttgaaggggaaaaaacatatgtccatattgagcacgtcaaagtggacaagattgaatacaatattgattttgaacagctgagtatagaagagctgagcggtatgctgaatatcggcgccacttaccatacaccggcgcacaggctcaaacaagcctgcgctgaagaaagtcgggacaacccgcaaaatgatgctgcgaaagaaaaaagacagacaaagcagcagacacccaatgtcaccatcagggggagaaagcattgaccccattgtttcatcctcctttttcgagggtatgtattaacagatgcagcgaagaatacagacgaaaaaggagatgatgaatatggcattatcaaaagaacagcaggacagcctttatcataaattaatcgatttaaaggaaagtcttcagggagaatccaaagaaaatcattcaatgagcgaagacacaggagaactgtcgaacggagtagataatcacttagctgatcacggaagcatttatttggacagggtcacgaatcagacgctggacggtgtcgatcagaatcttttagatgaggtgaacgccgcgcttgaacgaatggataaaggaacatacgggatttgcgagaaaacgggaaaagaaattccttatgaaagacttgaagccgtaccgtacgccagaatgaccgtcgaagcgcagcgagaaacagaaggggatgtgaaaacagacgctccgtcatatgaaagggaatttcacgagcaggtgaaagacctctcaaataaagaaaccgttgatcaaaaaagctcacaaacttacgaaatcctggatcgcgagcaggattcacaataatagcagcaggtacattcatatgtacctgtttttttattccataaaaaatctcagaatcgaaataaaatcattgactttatataaaaagaaagtaacatactatttgtaagtaaatattaaaagattaccgggaggaatttagaatgtctcaagtattatttgtaaaatcaagcgaccgtacggctgaagaaggcgtatccgtaaaattatacgaagcgtttctggctgcttataaagaaaacaatccgaatgatgaagtgatcgaacttgatcttcataaagaaaaccttccttacctcggaagagatatgattaacggaacattcaaagcttctaaaggaattgaaatgacagacgaagagaaaaaacaagcgtcaactgctgacatttacttaaatcaatttgttaaagctgacaaagtcgtgtttgcattcccgctttggaacttcacagtgcctgctgtgcttcatacttatgttgattacctgtctcgcgcaggggttactttcacatacacgcctgaaggccctaaaggtctgatgggagataaaaaagtagcgctcttaaacgcacgcggcggcgtatattctgaaggaccgatggcatctcttgaaatgtcattaaacttcatgaaaaccgttcttggtttctggggtgtccaagatcttcacactgttgtcgttgaaggtcataatgctgcaccggataacgctcaagcgatcattgaaaaaggactgcaagaagcgaaagatctggctgcaaaattctaattgccataactcttgcgcccctacagggtgtgagagttttttctattatagaagaaactggcggcagctttcgattcaatcttatattgatatattgatattttgtcgaaaaaacaatttttatgtagaataaagcatttttcacaaagaaaaaaggttttctgtaaaagaattaaccctcttgccaaaatacgactgatggtgtaggatataagagaagctacattgttcgtattgttaattaagttttaacctttaagctgtaatagggagttttatatcgaagccggaatgtcatgcctccattgcagaggacgacaggaacgcttctgcaaacacccactttgaggagtggtggtttaaaactttcttacttgcgtacggcatacgtagcgaaagccatttcccttgcggagatggctttttattttgaattgcccttgagcagcgtactttatcagtatgataaaatgaaagaatcaaagacaaagtgaggttttacaacatatgctggataaagcccaatcccttctggcgcattattttggctacgacagtcttcgcgcgggccaaaagcaggcgatacaatcagttgcagaggagagaaaaaacacggtctgcattatgccgacggggggcggaaaatcaatctgctatcagattcccgcactgctgtttgaaggaaccacaatcgttatttcccctcttatttccttaatgaaagatcaagtcgacgcgcttgaagaagcgggtatcgcggcagcttatattaacagcacccagacaagccgtgacattcatgagcgcctgaccggtttgaaacaaggggcttaccggctcttttacatcacaccggagcgtttgacttcttctgaattcattcacatcctgcagaatattacggttcctcttgtcgcaattgacgaagctcactgtatatcgcaatggggacatgatttcaggccgagttaccggaatatcgaaatcctttttaatgaattaaaagaaccgcccgtcatcatcgccttaacggcgacggctacgcctgaggttcatgatgacatctgcaagcagcttcatattaagaaagaacaaactgtatataccggttttgccagagagaatttaacgtttaaagtagtaaagggcgaaaacaaagaccggtttatcgagcggtacctcgaaaaaaataaacacgaagccggcattatatatacagcgacaagaaaagaaaccgaccgtttatatgagaaattaaaacgcagcggcatcaatgccggccgttatcacggcggattggcggatgatgacagaaaagaccagcaggagcgttttcttaacgatcagatacaagtgatggtagctacgtccgctttcggaatgggaatcgataagagcaacatcaggtttgttttacacgcgcagattccgaaagatatggagagctattaccaggaagccggacgggccgggcgcgacggtcttaacagcgagtgtgtgctcttattttcgccgcaggatattatggtgcagcgttttttaatagaccaatcggccgccggagaagaaaaacaaaagcaggatctcaaaaaactgagacagatggtggattactgtcatacggaagattgcctgcagcggtttattctgaagtatttcggcgagaatgaggcggaagcttgcgaagcgtgcggcaattgcactgatacaaggaccgcccatgacgttacaaaagaagcgcagatggtattgtcatgcatcatcagaatgaatgagcgcttcggaaaaacgatggtggcgcaggtgcttagcgggtctaaaaataaaaaagtgctggaaaacggcttcagcagcctgtccacttacggcattatgaagcatcaatccgcagcggaaatcagtgattttatcgaatttcttatttcagatgaatatatcagaatggcggacggcacatttcccacgcttatggtcacccaaaaaggcagggacgttctgcttggaaaaagcgcagtcgcgagaaaagaagccttacaggccgccgccgtcaccgaaaatgatgaattatttgagcttctccggcgtctccgcaaagagattgcagctgaacagggtgtgcctccatttgtcgtgttctcagatcagacgttaaaagaaatgtcggcgaaacttccgaaaacagatcaggatcttctttccgtaaaaggggtcggggaacaaaaaagattgaaatacggagcggtttttttagaagaaatccgaaattatgtaagagaaacagagtgaaaaaaagtttttttagaaatttgcacattgtgtttttcatgggcgccggaaaaatcagaagcttgaaaacccttgctgtatcaaggtttcagcaagacttaccaagcgagagaaatgtttcatgtaaaggaactgtaatctaattcaaatcgttttgttattgaactgacattttcatatgttacgatatcacctgttagccgccaataaaaagctaacaagggaggatttacttatgaagaagacgattatgtcctttgtcgcagttgcagcaatttcaacaactgcatttggagctcacgcttctgctaaagaaatcacggtgcaaaagggtgacacgctctgggggatctcgcaaaaaaacggagtgaacctaaaggacttaaaagaatggaatcagttatcttctgatttaatcattgaaggagagaaactgactatttcttcagtagaaacaaccacatctgggcagtacacagtgaagcagggcgacagcctctggaaaattgctcagaaattcggaacatcagtcggcaatctgaaaagcttgaataacttgcaatcagatataatttacgcaggcacaacgttaaatgtgaaaggtcaggctcaggctcaggctgcacagccggctcaagaagccagccagccgcaaactgaacaaaaaccagctgctgagacagaacagccgaaacaagaagctgtcaaaaacgagcagcctaaacaagaacctgttcaagaacaacaacaacctaaacaagaagcgaaggctgtcgaagcaaaacagcagcctgttcaatcaaatacaaaccaacaagagcctaaaaagcagatgacaatgactgcaactgcttactctgctaacgacggcggcatttccggtgtaacggcaaccggtgttgacttaaacaaaaaccctgatgcaaaagtcatcgcggtagaccctagtgtcattccgcttggctctaaggtttatgttgaaggttacggagtggcaacagcagcagatacaggcggcgcaattaaaggaaataaaattgacgtatttgttgcaaagaaaagtgacgctaacaactggggcgtcagaacagtaaatgttaaagtattagactagtttcatatagagatgaagaacacaaggcgaaatgctttgtgttctttttttcttcccttttttgactgtatataatcgttatatgcggaaaaagaaaaagcgtttctctaatataataaggaatggatgtgaaaaaagaatcggaagggatgaatctgatggagccggaatgtatatgtttatggaataccttcacagaatcaccggtgtttcaagcaggtatatgcaccgctttcgccattgtgctcgttatcggactgtctatgcctgctgtcaggctgtttcaggcgcttgacagagggagaggaaggccagccgttattgaaaaggtgagacgtactggcgtgatgaagaatggcaggcacgagcttgtacttattttaaacgtaaaaaaccaagacggaacgcatgataaacgtgaactgacacacgccgtatataatgaagagatcagccgtttttatgaaggagcttccgtatgggtgagggcagcggctggcggacgaattatgatcgctcctcgcacgccgcggcataaggcgtcaaaataaaaagacggggcggttttcccgtctttatgtattaatgccgatcgatccatatccgtccgccttctgagccggcttctatcctgcatgctcctccgatcgggaatgtcatcaaaggggaggtatggccgaaatcagcatttgcgataacaggcatggatgacagttcttcttttgtacggatgacggcacgcagagcctcctcagacacatttgaagcatgctggaaacgtccgatgacaattcccttcacggctgaaaaagcgggaagatggatgagtgactgcaaatcccggtcaaacatatgaatgtccgacatatgatcatcttctataaacagaatcacttgttccatctccggaaagtattcggtgccctgcagaagattcagcgtgcatagatttcctccgatcagtgttccttccgcatatccgggctgaataacgagcggtcccggattccgataaaaacgtctgtcctcctggttcaaataccatttatcatcactccactcggatgaaggttttacctcatacgggttgtcagaagcacagcaggccaagaaagagtcaatcgtatagtccagcccttttttcatggcaaatgaagaaaaatggggaccggaatatgtaataaggccggttttttgatatatggcatggccgagagcggtaatatctgaatagccgcaaaggattttcggatgccgcttgatgttttcataatcaacgtagcggagcagctgatttgattggaacccgccgagtgtcgtcaaaatcgctttgatgtcaggatcagcgaaagcttcgtgcagatcccgtacacgcgattcaatcgatgatgaatgaaattcatttatttctttcgcattctctgaaaaagagacacaaaagcccagctcctccaattttgtcttcgcggcatttatattttcatctgacatagcggacatgcttgtggccggagacacaatacggatgccgtcgccttttttcaatttttccggatacaaaaaaaaccctccttaaatggtttaatctattacaccatattaacgagggtttatctatcattttttacaggtcgacccatttaatgccgcctgattgcgtatcattgtcaatccagacatcaaattgatgcttttcataaaaatgaacgagccggtcgacatgatcccaatcacgcttagcgatgtcgcccgtcactttcgggatattctgctctctggcgatatgttttaaaaatttcatgcagatcgagccgtagccgtggttcggcgggcctttaatatccccgatatgaatggcattgtcataataagaagcgatcagtgaaaaacagcctcttccccggtaggctgattcacaatcagtcagcataatcttacatgtttggccatcatcaatcgaggaaacaatgatccaatcgtcattgttcgattgatcaataccaagcactcgcgcgtcttttgatacatctatcagattttcccgcattctgaaaatctgaaattcaagtttatgaagctctttttccagctctttctgatctctttcttctgcagtaaacaaaatcatactcctttcacagcgtaaaagtcttagtcaaacacaagtatccattgtagtaaatgatgtcttggtttgtaaatgggttttgcaaaaacttttttagaaaagtctgccgtttatatgtggattgacgtttttaaggcggtggggatagggaaaggaacagtgagcagcggaaaaaggaggaatctataatggcaattgactcactcatcggcaaattgaagtacgtaatgacggaatctcctgataaaatgctttccttatatgtaaatacggatatgagaaatccggatcagcaggggggagagtggaaaatcgccttgaaaaccggttttcggagattaaaagagtatctgtctgtaagtgatccggaagaagaaaaatctctcgtccgcatcatgcaacgtgtctatcaatatatcgatgggcttggtaaagagatgccgcgaagcctcgtattttttgcatcgggggaaggcggtgtctgggagacgattgaattgcaggtgcctgtcgaaacacgattttattgggaagaaacggctgtccttgatcaattagaacttctccgtgaacaatttccaagcacggcttttattctcacccagcagaatgaagtgaagatcatagaaaccgtactcggaaaaattgaaggggtggagcattatcaatacgacgtcatcaatgaatcgtggaaaccgcaggatgtaagcggaagctccgcatcaatggacgaagacgccgccaaagcccatgtcgaagaaaaccaaaacaggctgtataaacgattggcttcaaaccttgatcaaaaggccgcttcacaccaatgggagcgtctcgtaatcgcaggggacaaagaaacagccgatattctcgatcagcatatgaataaaccgatagatcggatcattccaaaaaatctgttgaatgaaaacgaacataaagtgatagaagaactgttgaaggaagcataatatgacgaaaggccgggtctcaaacacccggtctttttagggcttaagtttgtctaatttctgacgaagcggacgaaaccgttgacatcaaagctgaattctcataccatttggatagtcagtaaaattgagagaggtcataagatgaatcagacagaaaacaaacctaaaagttataccggtatcgtgctgacattgaccgttttgatcaacgggttaattgcggtgctgttttttatgccgaaatcgggacaggtcagcattgccaatattcatattctgccgatgttaaatgctatttttaacagctttacttttatctttttgctggcagcgctctttatgattaagcaaaaaaatattcaagcgcataaacgctttattttggcggcgtttacgacgactctgctgtttttgatctgctatgtcgtgtaccactcgatagctgagaatactttattcggcggccacggcatcattcgggggatttatttctttattttgattacgcacatctgtctttccgccgttatcgtgccgcttgcgctgtttacgctgatcagaggattcagcatgcaggtggagcgccacaaaaaaatcgcgagatggacgatgccgctctggctgtatgtcagtctgacgggtgtcattgtatacttaatgatctcaccgtattattaaaaaaagccgtgctctgcgcggcttttttctattgatggaaaaaggcgcctcatcagggcgccttttactcttcaagcgtttcaagtgttgttacatttaaggattgttcaacggtttttgtttttgcttttactttttctgcgtacgtgtaatcaccatagcagtagggataacggaaattgtctttgttccctccgcaagtgtaaagtttcggattctttttgacctgctgctcggagtattgttttgccagttcctcagtatgcgatcctccatgttcagccacaaaatcaatatagccggctcccatgttgtagctttgtataatcgtatccaagtctacgccttttttcttgcctgtttggtacatgagagtgaattgtttgattccctgtttgatactggtttgagggtttttaatctcatttcgctttaaacccagagattctgaagactgcatgggatcatttcctcttccttttgactcctgatatatcatgccgagtacaagcgatgtatatttggtgagtcctttttcatccagctcgtcttcaacaagcggtttgtaatctgtcagccgttcaagcacgatcggtttgacatcaaacggaagacttttgagccattcattatttgaaaataacagaatgaggaagaaggaaaccatgacaaaaacacatatcatcataagacccgcggcagcgaaacagccttttttctttttctccactgtgtttcaccctcaatttcaggagcattatgactttttcattatgacacagatggatgcgcgaaaccaagcggaaacccgtatttgaaacataaatttaaaataacggttcttttgtcaggcgcaggatgtatctgcatcaattgacatttggtataattgggctacttgagaaaagaagggtgaggtatatgactgaatttcacgaatccggaaagacgaatgaccccgctgtcgatttagatgaggaaactttatttttggttgcccagacttttaaggcgctgtctgatccgaccagaatcagaattctccatttgctgtcacagggtgaacacgcggtaaatgatatcgcagaaaagctgaatttgctgcagtctaccgtttctcatcagctgcgttttcttaaaaatctacgcctcgtcaaatcacgcagagaaggaacatccatctattattctcctgaggatgaacatgtgttagatgtgcttcagcaaatgattcaccatacgcggcacgattaaaaaacatccctgctttttagacagggatgtcagccgtactgactgttattggtttggtctctgctcgtttttaaaacataaaaagagaagccgctgtaataaactgcgatgaaataaaagatactgatggtcagcggatcggccccgaccgtttggctgtatgcctccggatgggtaaagtccgctgtgacccggtaaatttcaataacgcgataaacaaatctcgataggaaaaacgttaatagaataagttcaatccacagatgagtgcgaaaatacatttttccgcggcgttcttcaaaagaaatattccgtttggcaaacaggaccagaagccagccgcaaaaagtgccgaatataagatggccgtataaagccgggtgtgtgatgctgaaaaacgccagagctgcggccagcaatgaaaacaaaatcattcttgtataaagccagcggggtttcaaaggctgaaagccgacggaccgtttcacctttttatacagaaaaaaggcaatcattaagacagggcagatgctttgaagtgtgatatgcatggtgtgaaactccccctccgttgagtagtgtatgcttatccggctggttttagtagtctgatttattcgcaggctgaaagcatcttttatcacagtatgcgcgtttcttttttttgcataagagaagcgcccgcgcctttttcaggatttaaacagaaaactcttgataaactaacggtattagttataataaaactaacgatattagttttagggggatgttgatgagaatcttacaatacggaagggtttggcagctgactttttttccagcgcttttcccggtgaattgttatttggtcgaagaagaagtaggagtaaccctgattgacgccggactgcctaacagtcataaaggaatcaaacaagcattgcggcagcttgggaagccgctgaatgacatattactcacccacgcgcacggggatcacatcggttcgcttgactcattagctgcggaatttccggatgcctccgtctgtatttctgagcgggattctttcttgctgaaaggtgacacttcattatttgagcatgaagcacaaacgccgataaaggggggagtgccgaaaaatgttcagaccgaacctgatcgcctgctgaaaggcggcgagcggatcggatctttacttgtcattcccgctcccggtcatacgccgggaagcctcgcttttaaagatatgagaaatgatatgctgatcgtcggagatgcctttcaagtacggggcggccttgctgtttcagggaagctgaaatggaaatttccgtttccggcttttgctacgtggaataaagaagaagctgtaaaaacagcaagaacgcttatcgctcatcaaccaagcagtctggccgccggacatggaaatgttctctgcaatcccgttgaaatgatggctgaggctgctgaggaagctgaacgaagcctgccgggaggccgatcataatgtcaccgagagtcggaatgagccttgacatgatattgagagccgcagcaggcatcgctgacaaaaaagggctgaacgaagtgacgcttgcggccgttgcaaagtccttaaacgtaaaaccgccttccctttacaattttgtcaatggccttcaaggaattaaaacagagctggctgtctccggtttaactatgttatttgaaaaaatggcggcctctgcagaaggactgacgggtgaaacggctttgctcgctcttgccgatgcctatatcaatttcgccgaagccaatcccggattatatgacgcaacatttcaaaagataaaagacggccggattgagaatctgtcaagcctgcttgtagagcttgttgtcaggcagctgacagctaacggttatgcacagtctgacactgcgattcatgctgcgagaggactgaggagccttcttcacggctttgccgtgttgagaaaacagagtgcatttgaattaaccgaatcaattaaggaaagccggaagtttgcagttgttgctttcctaagaggtttacagggtaggtaacaataatattattatgtaaactaaataaaaaaacgcatcagtaaaaggagggacaaatggattcattacaacatatcatttgtgagcggcgcacctattcacatatttttgattctcatgcacacacatactgccaaatgctctttccgctcgaaggacagctggacttggagacagaaagacgtgaaatcagattaaaacctgatcaaatgctgtatattccgcccgggcatgaacatcggttccgttctttggagcgaaacgaatgtctcgttctcgacataccggcatattttttcaaaggttcatttgatcccggcgttctgaataagcttgattctttttggacatcgattcggtttctgctgacagaagagactaagcagcagtcggctcattcattgagtctgcttgcagaatatattgctgaaaagatacaagaaaaccgtacgaatgattcaattgcgtatatccgccgaaatctctcaaagactttttcaattaaagagcttgccgcaatggaacattaccacccggcgtattattccgactggtttaaaaagcagacagggaaaagcccgcaagcttatattgctgagctccgtatgaagaaagcggaacaaatgcttattgaaacaaaatgccggctgacagacatcagtcaggaggtcggctttcaaaatttgtcttcctttaccagatggtttgtcagacataagggaataacgccgcgcgtcttccgaaacacctttcaatctgataaataatcctgaaaatcagttaaataaactgcgtctttttttggtatcatgattgtaaaaaaggagtttttgatatggcagtcatcgaagattttatcaagctcgatctcagaataggaacggtcgtaaaagcggaagtattcccggaagcaaaggtgccggccattaagatgacaatagatttcggcgaagagatcggcatgaaacaatcaagcgcccagattacaaaacggtacgaaccgggtgatctgacaggcaggcaggttaccgctattgtcaactttccgccgcggcggatcgccggatttaagtcagaagttctcgttcttggcggcatcccggaaaaaggagatgttgtcctgcttacgccagagcagtcagtaccgaacggaacgaaaatcggataataaaaaaagacgtttgcagaagcaaacgtcttttgcgtattgaggcgatacaccacacgccacattcgtgtgtgccgcaagggcatgtgcatcggcttacacaattcagctcatcgctatatgaatatagcatggccggtgtggaaatgcaagagattttttaatatatgttatatctggctttgttttgccgatccccgattccttcgtgtaaggttcgtttgaaattttatgatcttgaataaagcagttcgacaaatgcaagagggaatttgagcaagttgtgaccgaagtgtgacctggaattaaaatccgggtctttttgtgtaaaagatgcatgcgaagagaccatataggcattaaatgttattactgatgtcttcatttatcttttggctaagtttctgaaccttctctttaacatttgaaacagctcttttttgaatttcatcaaagttctcctgaatatagtccatgacacttcttattataacttcactttcaaaattgaatatctcatttatttctgactgttcttcatctgttaggtgatggtattgaagttgtttagcatttacttcagcagctgcatcaatcctaacttagttgttctggctgtacaatttcatattcaccttctgcatacttttgctccgcataatggtctccccattgacagagctcctgcaagataggtttaagagattctccaagttcagtggatgaatattcaaccttcggcggtacttggttatacatctttctgctcacaagtccactggcttcaagctctctaagtgtttgaatcagcattttctgagttatatttgggataatgcgctttaattcactcgttctcttcggtccattcattaaaaagtataatacaaggcctttccattttccgccaatcacttcctttgtcacttcaaacccacagctaaattttttcatgtctaaagctctccattccacatttattactttttagttactatatcacaaaaaagtgggtacttccgataatgtgcttactgaaggatactattacttgtaagttgttcttcaagtacttaaaggtactagacataaaataatattaattctaaaggagtgttaagtatgggtgaatttgaaggtaaagtagcgcttgtaacgggtggaacaagtgggattggtcttgctgcagcacaaaaatttgtaaacgaaggtgcatatgtttatatcacgggacgtagacaaaacgaacttgataaagctgttaaccaaattggcaagaacgtaaccggtgttcaaggtgatatttctaagcttgaagacttagacaaactatatgacatgataaagcaggaaaaaggtaagttggacatcctttttgctaatgcaggcatcggcagctttcttccattaggtgaaattactgaagagcaggttgatagaacgttcggcattaacgtgaaaggaaccatttttactgttcaaaaagcgttatcactattcccggacaaagtaggttctattattgtaacgggctccaccgctggatcaattggcaacccagcatttagtgtatatggagcatctaaagcagcattaagagcactggttcgcaactggattcttgacctaaaaggtactgaaatccgtgtaaatgtggtaagtccaggagtgattcttacacctgcatacgatgagctttttggtgatgcacttgaaggagcgatggaaaatgccagaaatactgttccagctggaaaagttgggacacctgaagaagtagctaacgctgtatctttccttgcttcagacgaaagcagttacttgacgggtattgaattgttcgtagatggcgggctagcacaggtataatttcactgcgcagaggttacaaatcttccccaaaaaaggttaatggggatttacttgaagaagccgtataaaaaagtcgttttccttaaaggacagggaattcgacttttttatgtttgaatttgattaacgttgtaaattcgcattttcctggggctgccactaaatgacctgtaaaaaagattactttgtgaataaatgtacttaaagtaacggaaaggagaatgtccagttgttatttggagtgaattcggtggctataaagaacttaattctgcccattttataaagttcttttatgaaagacttcatgaaatgaaagaaaatcgggaagaagatgaagactaagacgattaataaaagaaagctctcttttagagagcttttttcagattttcaatttttaacaggctttataatgagcaaacaggcattactcaaaatactcgccgcgcctatccaaagcagccattgtgttgcggtcagccatgaggcagttaggataaagagtccaatggcaattgatatataattgccggctcggtccagtttacgattgcaatgaagtttatatttagcatgagaaataaattgatcaattttatctttcagctcatagcatttttccttcatcttatcctcagtttcttttacttttcgataaagcatattattcatcgtttgcactcccatatcgccgttttgaaaattcagccatgattttttcttcatagtcatctgagatggattgtgcctggtcttcaactttcaaatgtgctttttcttcaaaaccgtcctgttcttcaccatcaaaacgataaagtttttgcaatagcctccagaatgtttcaacttcttcagttgtgaactcatgaaacatatccgctaaaaaataggtggatctttctgaacaggaaattaacgctttttttccttcaggggtaatctcaatattgattgcacgtttatccagtttgcttggcacagtgtgaacatatccttttttcgagagacttgaaattaatttgttagcggtttgttttgttgtgcccagctttttagcgatattcataagtgtggtatcttccgtcggtaaatgggcaatagcaataagagtcatgtgctgtcgggaagtcaacatttctaagtattcgtccccccgagtctgcaccttattgacaaccgaaaataatgatgcgtaactttgttgcataaaatgcagttccttcattagtaatttaatatccataagttatctcccatctaaattgtcaccatgttgacaattacaatatacatcacgaagggaaataagtcaacatggtgactaatagggcgggtacggctgttttcaaaaatgccacagacagtcggagtgtttacaaaaggggaaataagtataataaatgcgaaaagggcattaatccaaagtgggaaggtgtttgacattcagaaagtgaactggtcagaacggtatgaatggttcaataaacaagatgaaaaagatgggcgtttaatggcgttccttcgtcatgagcttacatatgaggaagtcatacggttatataagaaagggttttatttgaaatcaaaagaaggggatgtttcgttacgtaagaacgatatctgtcgtatgtttggggttgaagagaggcagtggggcaaatcttaatgaacgggaagagaaaaactcttcccgcttttcatagcagctgttattctttttccagcatggaagtcagccattctcttaatgccggtttctgcacataccgctttccgtttctcgtgatatgcggaatgtcagatattcatgaggatcaggtgagttaaagttttcaatccgtctccgatgaaatatccggctaaagcgattccaatgccggtaatatatccaaacctccaataaacgttatcattttttatacggtgaagccggccggaggattcagccttcagcaaaaccgccgggcgtttattgcggacggttttgattgctgagcttttccacctgcacctttccggagaagaaaacagcacctccgcccatatccgccagccgatcgggcgtgagtgaattgacgagctgttttttatcatccatatcggcccaaagaccttggctcaccgcaacgccgggaagcacctgttcgccgaccgaaacagtcaattcgcactctccgcggtgattccaaactctaacggtttctccgtcttctatgttccggtgtacagcctcttctgtatgaataaaaagttttggcgctttttccagttttacgtgtttttcgttatttgaaaatgtcgaatttaaaaaattatgattcggtcccgggacaaataaaagcggaaaatcgtcatcgctctcaagagggatgtgtgtcggcagcgccggataaccgtcctgtttcatcttttccgaatataattcaattcttccgctcggtgtcttgagctttcccggaaaaagcggttttttccgtttggctttcatgaaggaatggcttgagagcgcttcgtaatcaatatcctcgatatacggattgtcgggaaagtccagcgcctgtctgattaattcttcatcagaatcctgaagctcctgctcggtaaatcccattgctccggcaagcagacggaacacttccgtattcgatttgctgtctccgtagggttcgatcaccggtttttgcagctgaataaaatgatgccagtaagacgtgtaaaaatccgtgttttcaaaagcggatgaagcagggagcacgatatccgcatatttggcggtttccgttaaaaacagatcgtgaacgactgtaaataaatcctcccgcagcaggccttttctgactttattcgcttccggcgcaaccactgcgggattcgtaccgtaaataaacagggagcgcacgggcggttttgtttctaaaagaacgcttccgagcctgttcatattaaatgatcgcggcttccggccgtaaagcagatcaggccgctggagcgcttgtctgttatagtttaataccgcgctgttgtgcttgattgcgcctcctccggtgttgagccactgtcctgtaacagccggaaggcaggcgacggtgcggacgatcattccgccattgtcatggtgctgaatgccgtttccgatcctgataagggaaggggaggtttccccgtacattctcgcaaggcgtctgatatcgtcggctttaacgcctgtaatagcagaaaccgtttccggatcatagtgtttgacatgcgcttttaattcgtcactgccttcggtgtattctgtgagaaatgcttcatcgtgaaggttctcagcgaataagacatgcatgataccgagggcgagtgcggcatctgtgccgggacgaatgggaataaaccaatcagcaagccggccggtttggttcttatgtacatcaataacgacaatcttagccccttttttccgggctttttgagcaatcatgacttggtgcatattcgtgctgacggcattgattccccaaaaaataaagagcttagcatgtatggtctcctccggatcagtacccgctccttctcccattgtatagttatagccttcagaaccggctttgctgcagatcgtccgttcgagatgactcgctccgagacgatggaaaaaacggcggtccattccctctgccgccagttttcccatattgccgtaaaagctgtacggaagaatgctttccgctccttcttcggcaataagctctttccagcgcgaactgatcgtattgattgcttcctcccaggaaataggcgcaaacgcggcttcaccttttttaccgatcctttttaacggaacggttacgcgcttctcatcataaatacgctcagccatgtgtctgactttgttgcaaatattccctgatgtgaccgggtgatcggggtctccctgaatgttaacgatttttccgtctttttttgtcacaagcaagccgcattgatcgggacagtctagtgagcacaccgacttaaagaccccgttcggctgtgttgcagcagaattcatagcccatttctcctctttgtttatattgtaagcattataacatttcaaaatcgaacgtcaattcagaaaaaagtgttgacattacggaaagacttttctatgatgagtttattcttttaaacagcctgacaatttcatcattttattttctatccagagaggtggagggactggccctatgaatcctcggcaacatttattgtgccaattccagcaagcgtatgcttgaaagataggaaagaatggtctatacatatttgtgcgcttcaagcgtataaagacggtatatgaatctctttccttctttgaggaaagagatttttttatgaaaaaatttatgtgaaaaggatgttttgcaccatgacggttttaattaccgcgccatatcacgacgaggggctgaaggagctggctgagctgttcggccggactgtgcaccggccgtggaagaagcacggccgggcctatcgggaagatgaattgatccggatgattcaagagacaaacgcgtcggggcttataaccgaacttgatgaggtgtctcagcgtgttattgacatattgccggattccgcttttatcggtgtctgcagaggaatgccgtctaatgtggatattgcggcggcgactaaaagaaaaatccccgttttctttacaccggcccgcaatgcccaggccgttgctgaaatgtttatcgggaatgtgatttcatttttgcgtcatacgtattcttcccatcagtggctgaaggacggaaagtggaatggtgattatttgcaggcttacgtcaaattcagaggaaatgagctgacggggaaaacagtcggccttatcggtttcggagctgtcggacagagaatcgccaggctattggccgcttttgactgcaaggtgctttactatgatccatttgtccgtcatgaaaaccgggagtatgaaaaaacgacgattgaacgggtattttctgaaagtgatattgtttccgttcacttgccgcgcacagaagaaaccatcggccttatcggcgcccggcactttcaattgatgaaacaggaagctgtttttgtcaatacgtcaagagcggcggttacagacagggaagagctgctgcgggtgctgaaagaacggcggattaagggagcgatccttgacgtgttttatcacgaaccgcctgaatcttctgattatgatttgatctctttgccgaatgtgttcgcgactccccatttagcgggcgcaacatttgaagtggaagatcatcatgtgaagattttaaatgaagcgcttttcaaatggaaacaagatcaaacctattcaatacgtgaactttataacaaaagagaacttgaaacggaaggaggaggctgtaatggctgaacaaaaaggctaccttgtatttgacatcgggactgggaatgcgcgagtcgcggtcgtgactgccggcggcgaagtgaccgcgcttgaaagggaagacattgaatatgtgacggatccgctttatccggacggacgatatttctcaccggaagggttatggacgcaaatcagcgctatggcaagaaaggctattgccaagagccctcatattacattaatcggaatcacctcaacaagccagaggcagggaatcgttttgatcaataaagataaaaaggcatttctcggtctgcccaacattgataacagagggcgtgaatgggaaggcggaattgaggcagaagaagtgcatcagcaaaccggacgtcttccgagcgctttattttccgccatgaaacttgtcggattaaaagccagacagccgtctttatggaaagaagtgaagtgcatcacaagcatcagtgactgggtgacatttgagctgagcggaattttaagctatgaaccgtcacaggctgctgaaacactgctgtttgacgtaaggaaaaaggcgtggtcagagaaattatgcaacatcttcggtgtgccttctgccattcttccttcactcgtccgatctgggacggttgtcggaatgttaacgtttaagaaagcggcggtgctcggtctttctgaaagagtgcctgtgattgcaggcgggggagacacacagcttgccatcaaaagtgcagatgcaaagccgggagatatcgtcattgtatccggcacgacgacgccgattacaaagataacagcggagaccggaaccgaaagtttagagaatgcatggctgaattgccatacagaagaaggtgaatggcttcttgaaacgaatccgggtgtaacaggactcaattatcaaaaattaaaatccattttttatccgaatgaatcctacagcgtcatggaacgggaaatcgcaagtctgccgaaacatgatcatgcctgtatatctgcgttaggctcctatttatctcctgagaaaaacgcactggcaaaaggcggatttatttttgacgctccgctgtcccaaaacttaagcagagcccattttgtcaaagctgcactgctggaaatcgctttttcaatcaaatggaactatgaggcgttaacagaggcggcttccttttcacaagattatgtgaaggtgtgcggcggcggtttccaaagtgatgctttgacgcagtttcttgctaaccttcttcaaaagaaaatctataagagagaggggttcagccaggcatccgcaatgggagcggtgatgatttgcaacgaagctctcggtgtgaaagcagagctttcgacctgcacaaaggtaattgagccggaagcggatcagacggatctcttcctatatgaagaatggaaacatacccaaaaattatttactcattttcagccggcggtgaaagcctgacttggggatgagatgacaacatgaaagattgctgaggaggaacaaaaatgcttaataaaataggaattccgaaacagctcgcctggggatttttaggggtcgtgctgtttatgatgggggacggccttgaacaaggctggctcagcccgtttttagtcgaaaacggcttgacggtacagcaatcagcatccttgtttacggtttacggtatttctcttgctgtggcgtcgtggttttcaggagtctgcctcgaagccttcggcgcaaagcggacgatgtttatggggctgttgttttacgtcatcggaacagccgcgtttatcgcatacggatttgagaatcttaatttgccggtgatgtatgtcacgtattttattaaagggctgggttacccgctgtttgcctattcatttttgacatgggtgatttaccggtcgccgaaaaacaggctcagtacggcggtcggctggttctggattgcatattgctgcgggatgtttgtattcggtgcttggtattcaagctgggccatcaaatccttcggctatttgaatacgctgtggagttcaattttctgggtatgtctcggcgcgttttttgctttgattttaaatagggaccgctttgaaaagaaaaaggcagataagcgggaaaaggcgcaggaattaatgaagggaatcaccatccttgctgaaaatccgcgcgtgctctctgggggatcattcgaatcattaacagcatcggaacatacggatttccggtattcctcccgatgcatatggcgcagcacggcatttctacaaatgtatggctgcaaatttggggaacgatttttctcggaaatatcgtctttaacttaatcttcggcgcagtcggcgatgccttcggctggaaaaagactgtcatgtggttcggaggagtgggctgcggcatttttactcttttattatattatgctcctgttgtatcacatgggaatttgctgttcgtcagcattgtcggttttatatggggagggctcctcgccgggttcgttccgatcggggctatcgtgccgacggcggccggcagcaataaaggtgctgctatgtctgtgttaaatctggctgcgggcctgtcggcatttgtcggccccgcgcttgcctgggcgttcatcgggcttgtcggcgcacaaggcgttgtatggattttcgcagcgctctatttcgtaagtgcgatcttgacaaatcaaatcaaaatacctgaagagaaaacggcaaaacacaataaagcattgcctgaatacgcttcttaacagcagcgccccgaaaattcggggcgtttttttacggctgatgaagaaacccggcaaaccgctgaatttgttcacgtaacgattgtttgttttcgtgaaattgtttgaaacgatgtccgtttgctccggacggatgcgggaagccttccagaatgaccgcatggcccattctgcggttcttcttcagcgtgcggcaggctgattctgctgcttttccgagagggataagcagaatgtcttttttcatcatttctatttcatccggaaaacatgtcagcgcgtaacggctgagaagagctgatctgctgatggccggccggtgtcccgtatagtttttctgtttataaaaaacagggtgtttgataacggatgtcgtatgaagcagctccctttttgaatcaaaaaaccgggatgaatcctcaacgtgaagcgcggccggcagaccgcattcattaagcatttcgatgatgtgctgcctcatggaaccggaaagtccggccgctttttttgtctcatatgctatcacctcaagagattcgccgttttttaaaagctgtgccgctgctttgtacgcccgctgcatctgaaaaaaaccgggtgtaattccggagatgacaaccgcagcatgtgggttgatatactcattatgaggcgaataatacatatccagatctccgtccttggctaaatggaactccgaagtcagcaaatccgattttgtaaatcctcccgaagatgataatgctttaagctgctgcaaaaaatgcgcaagccgctcacgatcgcaaatcatgttatgcctccttgaatccgccagtttctcttagtgtcatcaaaaacgtcggatgacatgcaggctcataaaccgcttttaccggcgttccagagcattttcaggacgtgaggcgttcctttaacttcggctgccgtcgtttgcacggctgtttttttagtaagaaagtcttcctgcagttctttctgcttttgtgataacaaacgggtttctgttttgatttcttcaacggacgtctgcatggacgctgtcacggcgttaatcttctttatatcaggcgctgtgtttcttttaaaatgcacggcggatacggctgcataaattaaagcggcagccgcaacggcagcactgatatacaaaatgatgatcatctgcttttcactcctttttttcagttgataccctttacggatcgtgctgaatcattttatttgctaattgttttttttctgcttataatgtgaaatcgtacataaggacattcagaaagggtgaaagacatggaaagcttacaaaacaaaacggctcttatcacgggtgcgggcagaggaatcggccgcgccgccgctatcgctttagccaaagaaggagtcaatatcggtttaatcggccgtacagaagcaaatgtcgaaaaggttgcggaagaagtgaaagcccttggtgtaaaggcatcattcgctgctgccgatgtaaaaaaccaaaaagaggttgaacaagccgtctcttctattaaagaagaactcggtgaggttgacatcctgattaacaatgccggaatcagcaaattcggcggatttttggatcttacgcctcaagagtgggaagacatcattcaagttaatgtaatgggtgtataccacgtgacacgcgccgttcttcctgaaatgattgagagaaaatcaggagatatcattaatatttcttctacggcgggccaaagaggcgccgcggcgacaagtgcgtacagcgcttctaaatttgccgttctcggtctgaccgaatctctcatgcaggaagtcagaaaacacaatatccgtgtcagcgcaatgactccgagcacggttgcaagcgacatgtctattgaattaaatctgacagacggcaatccggaaaaagtcatgcagcctgaggatcttgcagaatatatggttgctcaattgaaattacacccgcgcattttcatcaaaactgccggtttgtggtcaactaatccttaatcaaaaggggacctgtctttgtgacgggtcttttttgttttcgcaacccgattaaataggcataaagatccgtttttgcagaaaaaagagtgaaaaagaaaccgatatcagctataattaaactaaataaactatgtaccaaatgttcaataagattatttttccccgcatccaaaaaacaaatcaatataaaccaaactgtccgaacaataaaagggaaaacgggatataaagagaatatttagtacatggaataatttgttagaaggaagggtgggcacatattgaaagaagaaaaaagaagttcaaccggttttttagtaaaacaaagagcctttttaaagctttacatgattacaatgacagagcaggaacggctttacggactgaagcttctcgaggtgctgcgttcggaatttaaacccatcggttttaagccgaatcataccgaggtgtaccgttcacttcacgaacttttggatgacgggattttaaagcaagtaaaagtgaaaaaagagggagccaaactccaggaagtcgttctctatcaatttaaagactatgaagctgcaaagctttacaaaaaacagctgaagacagagcttgaccgctgcaaaaagctgatagaaaaagccatttcagataatttttaaatccggccggaacgctcccggcctcccgggctcaaaaggtttgttctgtgattcattatacataataacaggctcggaacaatacatatcaataaaacctccaaacttgacatcgactcctgaagtggtaacataaaaaacgtgtgaaaaatacgaacaaaatacgaacaagggagatgttaccgatcttagatcaaaagaaagttgcttttatcggagcaggatcaatggctgaaggaatgatatcaggcatggtccgcgcaaaaaaaattcccaaccaaaacatctgcgtgacaaaccgccgcaatacagagcgactcgctgaattggaacatcaatacggaattcaaggcattgcttttgacagcatgaaaaccgaagacattgatgtctttattttagccatgaaaccgaaggatgctgaaatcgctcttgctacgctgaaacggcgtattcaacctcatcaaatcatcctgtctgttctggcaggcataacaacctcatttatacaacaatcattacatgaccgtcagccagttgtaagagtgatgccgaacacatccagcatgatcggcgaatcggcaacagctgcggctttcggagaccatgtctcttacggttcagcaaaaaccgcggtatctcttttggaatgcctcggggaagtgtacgtgatcaaggaagatcagatggacattttcaccggcatcgcaggcagcggaccggcgtacttttattatttaatggagtttattgaaaaagcaggtgaagaagccggcttagacaaacggctgtcccgcaaaatcggggcgcaaacgttattgggcgctgcaaaaatgctgatggaaacgggtgaaaaaccggatgtgcttcgggaaaacatcacctctccaaacggcacgacggaagccggcctcgatgcgctcaggtcagaaggcggcggagaagccattgccaaagccattaaacacgcgaccgaacgttctattgagatcagcaaaacaattgaaaaaacggcagcactataatcgttaaaaaacaggagtgatacagtgacgtctcggacgaagatcaaaagagtcgcggtgaaaatcggaagcagctcactgacgagcctgcacggggaaatcagcagaagaaagctggaagcattggtggatcaaatcgcacagctgaaggacagcggctatgaagtgattttaatatcttccggcgcagtggcggcaggttatcggaagctcggatttattcagaaaccggaaggcctccctgaaaaacaggcttctgcttccatcgggcagggattattaatggaggcttactcaaagctgtttttagcgcacggttatgtcgcatcacaaatattaattacaagaagcgatttttccgatgaataccgctaccataatgtgcgcaatacgatgaacgtccttttggaacggggcattattccgattattaatgaaaatgacacggtcacagtcaaccggctgaaattcggagataacgatacacttgcagcgaaggtggcaggtttaattgatgccgacatgcttgtaattttatcagacattgacggtttatatgatgataatccgcgcagcaacccgaaagcgaaaagaatcagacatgtaagtgacatcactccggaaatagaagcaagcgcgggagatgccgggagtgaaatgggaaccggcggaatgcgttcgaaactggatgcttttaagattgtgatggcctccggtattaaaggctttctcgggcaggctaacattccggacattctgcttcaagcggtagatgaggcggctgaaggaacttattttgaagcggaaggaaccctgccgttaaaccacaaagaacaatggcttgcatttaattccggccccgaaggcgaaattgtgatggaaaagaaaagcagccgcgatgtcgcaaacggaaatatggcgctgtcaccgcaggatatcgaacagattaagggcagattcagcagcggagcggttgtcaggctgcttgatcagcagggagaagagctcggactcggcatcgtcaactattcctcagcccagctgaagacatttaaagaaacgcctcacaaacagaccgatcaatcagtcattgatccggaagcgtttgtctgccacgttgaactatccattccgatcggctgagaaagatctataaaaatatgaaaaagcccgaggcttcgttttgaagctcgggtttgttttttattgatattgttcaagtttggagaaaaattgaatgacaaaatgatagaaatcatttgcagacggagccagttctcttccttttggtttaataatgcctacggtccgcttcacttgaggaaattcaatcggaattttgaccgtgaaccggggtgtggtttctgcaaaggtgctttcaggcaataaagtaactcccatccccgcggagactaatcctttaatggcatctaaatcctcgccttccgtcgatacaagcggcgcaaagccggcctgtctgcaagcgtcaatcgccatgtttcggagaataaacccttcaggaaataaaacgaattggtccccgcgcagatcaattaaatgaatatttttctgtttggcaagcggatgatgcagcggaacaagcgcgtaaatcttttccgtgaataagatattgcctgttatgtcggggaattccgtcggaacggggccgagcagcgcagcatctatatccctgtttcttaccgcttcgattaaaaacttataagaaccctggcggagcaaaaactcaacgttcgggtattcctctttaaatgccgaaatcacagtcggcaaaagctggcttgcaaggctcgtcggaaatcctattttgacggttccgcgattcggatcaagatattcatcaatttgttccttcgcataatcaattgctttcatcgccgttttaacatgttctaaaaattgtttgccgatcggcgttaatttaatatttctgccttcccgttcaaataaagtgactttcagctcttcttcaagatttgcaatctgccggctgatggcggattgtgcgacatgcagatgatcagccgcttctgacacatgttcccgttctgctacctccataaaataccgaagctggcgtaattccattgcgttcacacccatctatctcattttgagatgtatttgatctaaattatatattgtttatattgttttgaaaacttacaattaatttaaagttgtcagattttatgaccgataattaacggaaactgatcgggggagaggaattatgacttacaatcaaatgccgaaagcacaaggtctctaccgtccggaatttgagcacgatgcatgcggaatcggcttgtatgcccatttaaaagggaaaccttcacatgacattgtcaaaaaaggactgaagatgctttgccagctggatcacagaggaggacagggcagtgatccgaatacgggtgacggcgccggcctgatggttcagatccctgatgctttttttaagaaagagtgcggagaaatgaagctgccggaaaaaggccgttacggggtaggaatggtctttttctcgcaaaatgaagaggaaagaaaaaagatcgaaaaacaggtgaatgcattcattgagcaggaaggacagatcgttctcggctggagaaccgtccctgtaaatgtcggaaaaatcggaacagtggcacaaagcacttgcccgtatgtgcgtcaagtatttatcggagccgcaaacgatttgaaagacagccttgcttttgaacgcaaattgtatgttatccggaagcaggctgaaaattggggcgttcaagaacagcttgatttttacttcgcaagcctgtcaagccagactattgtttataaagggttgttaacgcctgagcaggttgacgctttttatttggatttgcaggatgaaaccttcgtatctgcattttcactcgtgcattcaagattcagcacaaatacctttcctacttgggaacgtgcccatccgaaccgctatctgattcataacggagaaatcaatacgctccggggcaacatcaattggatgagagcgagggagcagcagttcgtttcagaaagcttcggagacgatcttcacaaagtgctgccgattttaaatgctgagggcagtgactcatccattcttgataatgcgtttgaatttttcgtgatggcggggcggaaaccggcacatacggcaatgatgctgattccggaaccatggacggaaaacactcacatgtctaaagcgaaacgggctttttatgaatatcacagctctttaatggagccgtgggacgggccgaccgccatttcgtttacggacggaaaacaaatcggcgccatccttgaccgtaacggcctgcgtccggcacgttactatgtgacaaaagatgaccatattattttctcatctgaggtcggcgttattgaagtggagcagaagaacattcttcataaaaaacgtctggagcccggaaaaatgctgctcattgacttagaggaaggccggattatttcagatgaagaagtaaaaacagaaatcgccaatgaattcccgtatcaaaaatggcttgaagaagaattggttcaagtgaatcctgacccggaaatccgggaagaggaacaattcgatgatcttctcgtccgtcaaaaagcgtttggctatacgtatgaagatatccagaaatatttaattcctgttattaaagaaggcaaggacccgctcggctctatgggaaatgattcgccgctcgccgttttatccgatcgcgcccaatcactgtttcattactttaaacagctgtttgcgcaagtcacaaacccgccgattgacgcgatccgcgagcagcttgtgacctctacggtgacatggcttggggctgaaggtgatctgctgcatccgagtgaaagaaatgcacgccgcataaaattgtatactcctgtattatcaaacgaacagttttatgcgctgaaaacacttgtgcaccctgatattaagagccagaacatccgcacgctgttttccgatgacctggaaaaaggcctgaaggatttgtttcagcaagcggaaaaagcgatcaaggaaggcgtatctctgttaattttatctgacagggcaatgagtaaggaattgacgccgattccgccgcttttggccgtcagtgcgctgcatcagcatttgatccgtcaaggcctgcgaacaaaagcaagcattatcgttgaatccggggaagcgcgtgaagttcatcactttgcggctctcatcgggtatggtgccgatgctgtcaatccgtatttgacttatgctacgtataagcaggaaatcgatgaaggccggcttgatattccgtatgaagaagctgtcagcaaatacggaaagagcgtaacagaaggcgtcgtgaaagtgatgtcaaaaatggggatttcaactgtgcaaagttacaggggcgcccaaatttttgaagcggtcggcatcggtgaagacgttatcgccaaatactttaccggtactgcatctcagcttggcggaatcgatatcgagacgattgcgcaagaagcgaaacagcgccatcaagcggcgtacaaggatgattacagccaaactcttgatcctggaagtgaattccaatggcggaacgggggagagcaccacgctttcaacccgaaaaccatccatacgctgcaatgggcctgccgaaaaaatgattacagcttgtttaagcagtattctcatgcagcggatgaagaacgaatcggatttttacgcaatctgttcgccttcaaagaagaccgcaagcctttaaaattagaggaagttgaatcagctgcgtccatcgtgaaacgttttaaaacaggagcgatgtcattcggttcattaagcaaggaagcccatgaggctttagcgatagcgatgaacaggcttggcggaaaaagcaacagcggagaaggcggcgaggacccgaaacgtttcgttccggatgaaaatggcgacgacagaagaagtgcgattaaacagatcgcctccggccgtttcggcgtaaagagccattatctcgtcaatgcggatgaattgcagatcaaaatggcgcaaggagcgaagccgggagaaggcggtcagcttccggggaacaaagtatatccttgggtcgcggatgtccgcggttctacaccaggtgtagggctgatctcaccgcctcctcaccatgatatttattcaattgaagatttggcgcagctgatccatgatttgaaaaatgcaaatcgaagcgcgcgaatcagcgtcaagctcgtgtcaaaagccggtgtcggcacgattgcggccggtgtggcaaaaggcactgcggatgtcatcgtcatcagcggctacgatggcggaacgggcgcatcgccgaaaacgagtattaaacataccggtcttccgtgggagcttggtcttgcagaagctcaccaaacgctgatgctgaacggtttacgggatcgcgtggtattggaaacggacggtaagctgatgacaggccgagatgtcgtgatggccgccttgctcggtgcggaggaattcggctttgctacagcgccgcttgtcgttcttggctgcatcatgatgcgcgcctgccatttagatacatgtcctgtaggtgtcgcgacgcaaaatccggagctccgcaaaaaattcatgggcaatcctgaccatatcgtaaattacatgctgtttgtcgcagaagaagtgcgtgaatatatggcgcagttaggctttaagacgcttgatgaaatgatcggacggacagacgttcttcatgtcagtgaacgtgcgaaagcgcattggaaagcgggccagcttgatttatccacactgctgtaccagcctgaaggcatacgcactttccgtacggcgcaaaaccataaaatcgacgagtcgcttgatatgacggttattcttccggcggtgcaggctgcaattgaagccggtcaggaagcggaagctgaaatcaagatcaataatacaaaccgcgtagccggaaccgtgacgggaagtgaaatttctaaacgctacggagcggaaggcctgccggatgatacgatcagacttcattttaccggatcagccggacagagtttcggtgcatttgtccctaaagggatgacgcttcatttgaacggggattcaaatgactacgtaggcaaagggctttcaggcggaaaaatcatcgtgaaagcgcctgatgccttcaattatgaaacacacgataacgttattatcgggaacgtcgcattttacggagcaacaagcggggaagcgtacattaacgggcgcgccggtgaacgttttgcagtccgtaacagcggagtcaatgtcgttgtagaaggtatcggagaccacggctgcgaatacatgacaggcggccgggttgtcgtcctcggcgaagtcggcaaaaacttcggggcgggaatgtcaggcggtatcgcatacgtcctgagtgaagatgccaaagcatttaaacgcaaatgcaacatggaaatgatttcatttgaaaagctgacggatgaggcggagatcaaagaagtgcaagaaatggtcaaacggcatgcggcgctgacaaacagcaaaaaagccgcaaatctcctggacaattgggaaaaagccgcagaaacctttatcaaagtcattccgaaaaactataaacaaatgctcctcagcatcgaagaacaaaaagcggcgggtttatcagaagaagacgcaattatgtatgcttttgaagccaatacaaaggttcagcaaacgcctgccaaagatcaaaaacaagcggtagtacagtaagaaaggggagaggaacatggggaaaccaactggattcatggaagaaaaacgagaaaaaccggctgagcgggaccctctcactcgcttaaaggattggaaagagtattcggctccattttcagatgaagcgtcaaagcggcagggggcgcggtgtatggattgcggcacaccgttttgccaaatcggcgctgatatcaacggttttacctccggatgcccgatttataatctgataccggagtggaatgacctcgtctatcgggggcgctggaaagaagccttggagcgccttctgaaaacgaataactttcctgaattcacagggcgggtctgtcccgctccttgtgaaggatcttgtacgctggccatttcagatccggctgtttcaattaaaaacatcgagcggacgatcattgacaaaggttttgaaaatggatggattcagccgagaattcccgcgaaacgcacaggtaaaaaagtcgctgtcgtcggttcaggcccggcaggtctggcaagcgctgatcagctgaatcaagccggtcattccgtaacggtctacgagcgtgccgacagagccggcggcctgctgatgtacggcattccgagcatgaagcttgagaaaaatgtcgtcgaacgccgtattaagcttttgacgcaggaaggtatagattttgtgacaaataccgaaatcggcgttgatataacggcagatgagctgaaagaacaatttgatgccgtcattttgtgcacaggcgcccaaaagcagcgcaatctgctgattgaaggccgggaagcaaaaggcgtccattatgcgatggactatttaacactggcgacgaaaagctatttagattccaacttcaaagacaaacaatttatagacgctaaagggaaagatgtcatcgtgatcggcggaggagacacaggagctgactgcgtggcaaccgcgctgcgtcaaaaagcgcgcagcgtgcaccagttcgggaaacatcctaaacttcctcagacgcgcacgaacgacaatatgtggcctgaacagccgcacgtctttacccttgaatacgcctatgaagaagcgcaggcaaagttcggcaaagacccgagagaatattcaattcaaacgacaaaaatggtggccgataagcagggccgcttacaagagatccacaccattcaaatggaaaaagtcagaaacgaattcggaaagtatgaatttcatgaactgcccggtacagaaaaagtctggcctgctcagctggtgttcatcgccatcggttttgaagggacagaacagccattattgaaacagttcggagtcgattcggcaaatcataaaattcaggcggcatatggggattataaaacgaatgttgacggtgttttcgccgcaggggatgcgagaaggggccaaagcctgattgtatgggcgattaatgaaggccgggaagcagcgcgcgaagtcgacagttatttaatggggagcactgttttaccgtaaataaaggggtttatttataaaaccggctgggatcagccggtttttcgtattgaaatggaacctccttcttcttgtattggtcatataaaggtaatgtggaaatggaggataaatatggaattttgttttacagagcggagagattgtttttttccgcagactgatacgatttgcaagccttgcgcaatcgatcagggtgctgctgacggcggaagtcatcgctgccgtttaaaatgacgccttaaaaaacatgacgggctctgtgtgtctgcagtcgatttgcgggcagattttaatcgatgaagaaaaacatattgaatttcaagcggaaacgcttaaaaacaaataagggaacggacgggtccgttcctttttttagacatctatacgaaagccgatattgccgaactgccgtccttcccgcattctgttaaaagcgggagctgcttcactgagagggtacatgcggtcgataatgggacggagctcgcagcggtttatcaattccagcatatccgcgaattcctcattgcttcccattgatgtaccgagaatatgaatctgcggaaaaaacagcgagcgaatgggaaatccgagctgatcgcctgaactggcgccgaatgttacgatccggccattcggtttaataatgtcaagatagtgttgatataaagcggggcctacaccgtcaagtatgatatctgctttttcgccattcagcgcctcattccagtcaccgtagctgtcaatcgcccggtctgcaccgtatgacagtgcggtttgttttttgttttcactgcgggaggtgacgctgactgtcgctccgatagcttttgccattaataaggcatatgttgccacgccgcttccgatgcccggaaggataaggtgttcgcctttttttaattgtccttttgtaaataaggcgcgataagcggttaatgctgataacggcaggacgcccgcttcctcccaagtcaggtgttcgggttttaaaacggcattttccgcaggaacgatgacataaggtgaaaatgttccgtcgctcggaccgcctaaaatatcagggacggctggtacgtcctcaacagtcttccaattcagtaccgggttgatgatgacttctgcattcagtaaatgagaccggacgccgtgtcctatttcggttacgattcccgcgccgtctgaaccgagaataaattcatggtttccggtttcgtgttttttcattaaaaacaaatcacgatggtttaatccggctgttttcagctttatttttacttcgccgtttcccggccttttgtcaggtgcctgcctgaaattaaagccattttcgtgtatgataaggacattcatgattcttctctcctttatgattgatgagaaaaattttacaggctgtatcagctgcagtaaataaatgaaaattgatagccggctatcaataaaaatcatagcaagaaggtgcccttagatggaaagcggagacttaaagatttttcaggctgtcgcccgcaaaggaagtatttcaaaggcggcagaaagcctgcattatgttcaatcaaatgtgacaaaccggattcagcagctggaacggcaattgcaaacacagcttttttaccgcacaaatcggggaatgacgctgacgccaacaggtgaaaacttattaaaagacgcagacagaatccttcaattgctgcatgaggcgcaaaaaacagcgcgagaggcaggcgatccgaacggcccgcttcgaatcggttctcttgaaacggcggcagccgtccatctccctcaatttttcacggagtattgcagccgctacccgaaagtacagctgtctctgtcaaccggtgatacacataccttagtgcagcgcgttctacactatgagctggacggcgcttttgtttacggaccggtcgaatatgaagatcttgagcaagtcgctgtatttcaagaagaattggtcttggtttcaaataagcgggaaggcagtttgcaagacttgctgcgagagccgattctgtattttgccgcgggctgttcgcaccgccgcaaaataaaaaacatactgaaagaagaggcagtgcccgcacataaaatcattgaattcggtacgttggaagccattattggggcggtgcaggcggggatgggggtctcctttctgcctgcatcagccgtccgttattttcaaaacaggaaaaatctttttcttcatgagcttcctgaacattttcggaatatgaatatatcattcatctaccggagtgatttatttttaacatcggcgtttgaagaactgctgaatggattaaaaacattatcgaacagaagatgagaaaacaggacagctgtgtacgccaattttttttcgttccggtttttctcaaaaagaaagcgggtatccgggctgagctcgatcagcgtgatgaaaaactcggctataaaatcagagaagcacaaatgaaaaaaataccgtatatggcggttgtgggagatcaagagtgccgccaccattctgtacatgtaaggcaatacgggcgggaaaacacatttgaagagaatgtgagtgattttatttcccggatcataagagagacaaaacaaaaaatagagattcaagaaaaataacattgacatatcgcaaaatcacgatataataaagcgtatgaaacctattgatgtttttaaagcgttgtctaatgagtcacggcttgagattttacaatggctgaaagagccggaccgtcacttcgcaccgcatgatggcattgatatgaatgagatcggagtatgtgtcagccagatcaccgataagcttcagatgacacagtcaacggcgtctcaatatctttccattcttcagcgcgcaggccttatccaaacaaaacggattggcaaatacacctattataaaagagatgaagatgcgataaaggcgatggccgattattttcagcgcgaaatgtagggctgaatcctttagaagagggattcagtttcttttttcgactacacatcgacatattgcgatttgtttctgtttgttcaattctttatatcgatatatcacaatatatctttatataaattatcaatgaaggagtgtgtcaggtgcaaaatacctggaagatttacattttggcaattatcagctttttagtggggacgtctgaatatgtgatatccgggatgcttgataaaattgcaggttccttgggagttactgtggcagcagcagggcagctgattacgattttttcacttgtttatgcaatcggaacgcctgtcatgatggcccttacagcaaaactggacagaaggaagctcatgatctatgctcttggattgtttgtaatcggaaatatcatttcatttcttgtacagggatacggcttatttgcggcagcccgggtgatcatggcgcttggagcaggaactgtggtggtcaccgcgcttacgatcgcagcaaaaatcgctcccccgggaaaacaggcaagttctctcgcgaccgtcattatggggtttacggcggcgctcattatcggtgttccgatcggaagaaccgtgtctgaagcttttggctggaaggtggttttcgccggaattgcggcaatcggaatcattgccatgcttattatacgttttgcgttgcctgagataaaaggagataaaccggtgccgcttattcagcaattttctcttttgaagaaacgaaaggtggctgtcgggcttgctattacgtttttttggctcggaggctattcggttgcgtatacgtacctttctccgtatttactgaacgtcactcatatcggcagcggaatactgagtacattgctgcttattttcggtgttgctagtcttgccggttctaaagcaggcggtttcagtgctgacaaatggggggcgcgtatgacattaaccggcggaatggcgcttcatgctatcatgctcatgttattgccgtttgtcacacattctgctttcggagcggcggcagtgcttattttttggtccttcgccgcctggtcatcaggacctgctcagcagtatcatttggcaacgatggagcctgaatcatcgggtgtattacttggcctcaaccagtctgtgatgcagctggctatggcggccggggcgggcatcgggggcattgttgtcactcatctgtctcttgcgtcagtgacatggatcggatcagcgggtgttgtcatcgcgatgtgcggcgtgctttcacttgcctcgttaacatctgaaaaaccctcatctgaatacagtgcagaataaacaaaagcctcatttctcagcttgagaaacgaggctttttgcctagttattttttatattgtttcaagtttacgccgattgcggctccgtttcggcttgagtcggcaactccggtaaaggtgccgttttcacgatcgatcaggatgctttgcacattaccgatatcaaccgggctgctgccgaatttatgccccatttcgttcagttttgtgcgggcttcttccggcactcctttttcatatctataggatgtcatgctgtttgtgtaaattctcggctcttcgaccgccgctttcagatccatgccgtactcgactttgttcaggatcgtttgcaggacggaagaaataatcgttgctccgccgggagagccgacagtcaggacaggttcgttatttttgaataaaatagtcggagtcatgctgctgagcggacgtttattcggctgcacttcatttgcgccgccaggcaccgcatcgaagtctgttaactcattattcaacacaacgccgtatccgggaaccataatgccggaaccgaacagctgttcaatcgttgtcgtataagatacgacattgccgaagcggtcggttaccgtgaagtgggtcgtttggccttcttgtttgtcagtcggctgcttcacttgtttatagtttgcagaaccttcctgataggcccaagggtcgccggctttcggttttttattgactttatcaatatctatcagctgtctgcgggcattgatataatctggattcaagaggcctttgagagggacgttgacgaattctggatccccggcaaatgcggcgcggtcagcataagccaaatgcatcgtttctgcgagaagctgatatttttgccaagaacggatatcatattgagaaagcttaaaatcatccagaaggttcagcatttgcaacaggaaaacaccgcccgagcttggaggaggagcagttgcgatatgatagccctggtaatcccccagatcggttcgtcaatcgtcacattgaagtttttgatatctttttctgtcattgagccgccgaattcctgcactgtttccgcaagctttttggagaatgcaccgtcatagaatgcttttgtgcctttgtacttaatagctgtaaatgttttggctaagtctttttggatgagtgtgtctccttctttcagaggttctccgtccggaagaaacacgtcttttgcagcggtgtgtgataatttgtttttataatctgagatggcatcagctaaaaccgaatcgatcggaaagccttttgaggcaagtttaatggaaggggtgatgagttgtttcatggagcgtgtgccccatttgtcgagcgctttttcaagtccttttaatgttcccggaacaccgactgcagtccctttagtaacgcgttcggagaaagggatggctttgccgttttcgtcaaggaacatatccggtgctgcgcctgccggtgcgcgttcccggctgtcgataatggtggtgtctttcgtcttcgcatcataaaccatcataaatccgccgccgccgattcccgacatcataggttcagttacgtttaatgcgaattgaatggcgaccgcggcgtcaattgcattgcctccttttttcagcacgtcggcaccgatttgtgaagcgagaggatgggcggtggcaaccatgccgtctttgccgacatctacctgtttgtagtcgtcataggaaaacgggtgtttcttagcctgagcgtgataagggatgcttccggccgtgagcaaagtactgagcagaacgataaaacagagattcataaactttttctttttcatagtctgcctcctttgttttccgcttacaattatagagtaagtaaaatgtgctgttttcacaagtgacaaacggaatagtccggtgcgcaaaaagccggagtttctgtgtgaatgtaatcagtcgcaaataggctaaatgggaaaccgggcagaaaaagctgtgaaacaagcataaagacaaaaaataagctacaataaacaaaacagaattcactcacatgacatatgaaaggaacgtgagccatgtatttaacgatcaaagagacagctgagtttaccagtcttcctgaagaatatgtgcacaatcttgttttgacgaataaaataagggccgtacatgacggacagcaatatttaatcaacaaggaacaatttcaaacccatctcgaacagctggaaaaatataaggaaatgattcaagagtttttaaatgagccgcttcctgaagacattgatgtaaaagatgaagactaggacacaatttcatattgtgtctttttttttcatttttttcggttgctcacaaaaaaacgaatgctcagatttcgttttaagggcgttgtttttcttttttaataccgtgagtctctgttgatttaaaatcccgtcatcgggtcgaaaatgatgttttgaagacttcgatgaaactgcgtgccttattccccttatgtaacactatgtatattatgttacataaggccctttatcctttatcattcaacaggtttcggctataatagtaacataatgctcaatatgttactttaccaattataaggggttttttgatgcatatcgtacagccgatccgaagtttggagaagatccaggaagtcaaacagtatttaatgaagaaaagtgatcgtgattattttttatttattttcggcatgaacagcgcactgcggatttctgatgttctgccgcttcgcgtgagggatgtaaggaacaaagaccatgtgtgggcaaccgaaagcaaaacgagaaagaaaagaaaaattctgatactggagtctttgaaggccgacatatacgcttatacaaaagacatgaaagaggatgactatttgtttaaatcgaaacggacgaataagcccatttcccggattcaggcatacagaatattaaaggaagcagctgccgcgtgcggattggaggaaatcgggacgcatacgcttagaaagacgttcgggtatcatttttatcagaggacaaaagacattgctgaactgcagaggattttgaatcattcttctccgtctattacaatgcgttatatcggaatagatgaagatacgacgagagccgcctataaagtgttcggagggctgtaggcttgaaaaaaacggccgccagcgttactataatagaagcaggctctagtagcacagcggatagtgcagcagtttcctaaactgcaggtcgggagttcgaatctctcctagagcgttttcgacataagataggtgcggattaataatgtcggcaagacagaaaaccccttgttatacaaggggtttttgagtttaatattttgcaagaacctggtggaaatgatgtgaaaaaagcccgctgtaagcaagcgggctttttcttatatgacagcatcaaattgattgactttccaaacgttgttttcttttacgaatgttacatcgcgttttgctgacggtgaaccgtcaagagtcggtacagtgaagcggtatgtttgaacgcttccttttttagaaagaagagtcatttttgcttttttccaattcaggaggttatctccgtcgccgagcggaacagccaatttgccgtcttttacagtgaagtggtaatctttgagccctttgtcaatcgcttgctttgtaaaagcgggtgtcagatattttacggctttcgcttttgttccgaggtctttgcacataaagacgtattgaagattttgatattcaaacggttcagatgtgcagtttgcgtttgatttaagcgcaccgccgctcatcgtgttccagaaatgttctctcgctgacagggccagctgaagtgcttgtttttgtgtaaggtcattaggtgcattttttgcggtcgccgcagtgcccaatgacagaatcaatgtaatagtagtgaggaataatagccattttttcatgatataatctctccttcaatcaatctctttctcttatgttacaaatgttacaataattacgataagattacaataccttttcagaaatattttccggactttttatttttatggtttatttccatgtaagacgtgagaataagataaagagtttcattgaacaaaaggtttttacaagctgtctgctgaataataaaatggaagaaaatcaaaaaaggagtcctacatatggaagtacaagatcatttagaaacagcggaaggccgcggccagtctgtctggcgatcgatgtcactgtttttagtgccgctgcttttaagcaatgtattgcaatctgtcggccaattggtcggaatggtatttgtcggaaggtggctcggagttgatgcgcttgccgccgtatcgtctttttttccgctgttttttctgctgatctcctttacgatcggaatcggttcgggaagttccattctgatcgggcaggcttacggcgcgaaaaacgaagagaggatgaaggcgattgtcggcactacactgacttttacctttatgctcggtgttgttctggcagttgtcggcagtgtgtttacgcttgatattctgcggctgatgggaacgccggaaaacgtaatagatgtcagtgtccgatatgcgcgtattttgttttgcgcaatgccgctgatgtttttatattttgcgtatacgacatttttacgcggaacgggagattcaaagactccgttttatacgttaatcgtcagtacagtcataaacatcggtctcttgcccttattgattctcgggcttttcggacttccgaagttcggcatttacggttcggcgtatgcaaccgtgatttcaaacatcgtgacatttatcgtactcatggtttatttgcggaaaaggaaacatccattggcatttgaccggactgcgctccgttctcttaaaatggacaaaaagctgctcgcgcttttactccgtctcggtattccgtcaagcatcaatatgattctcgtatcactttctgaaattgcggtcatttcatttgtcaatcattacggatcaaacgcgacggctgcttacggggtcgtcaaccaagtggcgagttatgtgcagatgccggcggtaagcctcggtatcgccgtttcaatttttgccgcccaatccattggcgccaatcaattcggccggctgaagcaggtcatcaaagtcggcatcggcctgaattatttgatcggcggggttttgattgtgctgatttacaccttctcccggcagatactggctttgtttttaaccgatcaggatacactccgcattgcccgcaatctgattatgattaccctttggagctatctgattttcggtcacgctcagattgtttcagcaacaatgcgggcgagcggtacggtgttatggccgacgattatcagcatttttacgatttggggaattgaagtgcctgtggcctttattctttctcattatacgaatctcggcattctcggcatttgggtcggttatccggcggcttttgtcgtcagcctgctgctgcaatacggatattaccggtttgtatggaagaaaaaacagattacccggctgattcaataaggttttaccgcacatcgctcagttcatacgggcgatgttttttttagagaaggaaaatgagtttagaaaatggaattcctatacatgctagaaaacaaggaaagggcaggtgcttatgacgattgaacatacgacttatttaggagtttcagccataaaggcggagactgatcaggctgaatgcatcattgtgccggagtggggatcaaatgtcatatcgcttcgggataaaagaaccggtatgcggcttctgagagaaccggaaactgcggaggaattcctcaaaaaaccgatgctgtacggcattcccgttttattcccgccgaaccggattacggacgggacgtttcgttttgacggccgctcgtatcaattcgagataaacgaagaggataaacataatcatattcacggctttcttcacaatcagcattggaaagcggcagcagcgaaagaagagggggatggaatgacagtcgaaacagaaattgatctttcaaagattccccgtgttcataaacaatttccgcacgatgtcattgtccggatgacctatacattaaaagacaatgtgtttacgcagcgggcgctgattatgaataagggaacggaggcttttccttgggggctaggctatcattccacatttgttttcaatgaagagcaatcccgtctatttttgacggctgaccgcatgtgggaattaaatgaacgtttcgtaccgacgggccgtttattggatgttcctgataaagaagcgttccgtcatgggatgtctttgaaaaataaacagtttgacgatgtttttctttcttccggacggaatggcggcaataacgaagctgttatttatcatccgaatgagaaattatccgttttgtatcaggcagacacgtctttcaagcattgggtggtatataacggtgacggaaagcaggggtttgtcagtcttgagccttatacttccgttacagatgcatttaatctgaatcagcctgcatcactgacagggcttcagattctgaaaccgggcgaagaagcggctgcgtcatccgggatcaccattttgcatgacgaagaataggaaagaggcgggataacattgaaaacatatgtgaaacgcttgtgcgcggtgattctgcttttgatcattgccgaagttccttatattgatgatgcggctaaggcggctgaacaaaaaaatactttgcaaaaagagctggaacacattctggatgaagaacccgctttaaagggggcttcagcgggcatcattgtccggtcagcaaaaacaggggaggtgctgttcggcagccgggaagatatgcggctgaggcctgcatcattgatgaaactgctgacggcatctgcggcgctttccgttctcggagaagattacacctttaagacagaagtacgggcagacggcgccgtgaaaggaaaacagctgcgcggaaacctttatctcaggggaaaaggcgatccgaccctattggcttctgattttgagaagatggctaaacaggtcaaagccagaggcatccatgtcattaaaggagatctggtcggggatgattcgtggtatgacgataccaggtattcagttgatcttccgtggagtgatgaaggccaatattatggcgcgcaagtatcagctcttaccgcttccccaaatgaggattatgataccggaacggtgattgcggaaatcagcccggcgaaacagcccgataaaaagccgcgcatttcaatttctccctatacggacatcgttcgtgtgaaaaatgaagtaaaaaccgtcgcttctgatgaaaagaaagaattgacggttgaacgggagcacggtggcaatgtgattacgataaagggagccatacctgccggctcggcaaaggcaagagaatgggcggcagtgtgggatccgtcgtcctatgctttagatttatggaaacaagcgcttactaaacagggtgtaactgtaaaagggaaaatcagaacaggccgaatgccgcaccgcacccagcttgtcacatcacggacatccatgcctctttcagaattattgatcccgtttatgaaactgagcaacaacgggcacgccgaaattctgatcaaggaaatgggaaaagtgaaaaaaggggagggcagctgggaaaagggcttggacgtgatgaaatcggagctcaaatcgttcgggctcaatccggatgaattgattgcaagagacggatccggcgtttctcatattaacggcgtatccgccggccaaatcggagagcttttgtatgcggttcagaaagagaagtggtacccggctttccttcgttcgctccctgtcgccggtgcaagcgacagaatgacgggaggcactcttcggaaccggctgaagaatactccggcagagggcaaaattaaagcaaaaaccgggtcactaacatcagtcagttcgattgccggctatgcagacacaaaaacaggagatacgcttattttttccgtgcttcaaaacgggctgcttgacgaagatgacggaaaagacattgaagacaaaatcgcagtcgtgctggcaaatcaataagaagggccggatccttagagggttcggcttttttgatgtctgtaaaacattatattgcgattatgaatcaatcttttcaaaaagtaatatcggcaacattcttccttttttttacatgatactttcttacttgttcactgatttttcattttttatcataaaatttcttttcggaaagcaaaacctttttaaaagcgcaattaattatacattttattccttattatagtgttttagaaccagtttgcagtgtacatacatactgttttacatggtataaaaattatagaaatgaagaagtgaagtgaggaatatatactatattctaaaaaatgttagaaaaaatttaattttttattgtgatttctaaaatatgttttaaaataatgcttatatggatgatttagtcatatgctgtcgaaatttaattgtaattatttcactttcttatcctcttaaattgaaatggagggattccattgaagaacactgtttattctttaactcacgcccaaagaagagtctggtttacagagctgctcgagccgggcacaagtatctgcaatcttgcggcgtgcgtcaaattcagggggaatatcgactttgacgtattgcgccgtgctttagatttctctatcttgcaaaatgattcgctcaggtttcaactgacggaaggggacggctcagaaccccagctgtatctggccgggcatcggccgatttctttagagaccgttgattttactcatattgatcaatcagagcgggatgcatggattgacaaacagacgcgtgttccgttcaagctgtttcattcaccgctgtatcattttactctgcttgtcatgtcagacgaagaagtttggctttattcaaaatttcaccatattattatggacggcatctcgctcaatctgcttggcaatcagctcattgaaatctaccaaaaaatcatgcgaagcgaggatttggccgaacaccaaagcccttcctatctcagctacatggaaaaagaacagcaatacctacagtcttcccgttttcaaaaagaccgttcattttggactgaaacataccgaaccgttccggaacacctttcactggcggaacgaacctctcatcttagacaaagcactgcagcttcaagagatacaatcactctttcccactccttagaacaatcaatccggcgtttttgcaaagatcataatgtcagcatcatctctctgtttatggcttcgttatacatatgcatcagccgtctgacggctaaaaaggatattgccatcggtacttattacggaaaccgcggttccaagctcgaaaaggatatgctcggcatgttcgtcagcacgctaccgatcagaatgacggcagatccggatgcggagttcgtgtcttttgtccgcagtgtaggaaaacagcagctgtctgttatgcggcaccagaaatatccttacaatctttttgtcaatgaattaaggcagattcatcacgacctgcaaaatatcatcgggatttcgatgcaataccagcctctcgcgtggcgtcaggcagaaggtttcgattatgaaacggcgatgtttttcagcgggcatacggcaaatgagctgtccattttaattaaggagcggacagatacgggattgattgagctgaattttgattatcaatccgctttatttactaaaacatcgattaaacgaattcaaactcatttgctgacgatcgttgaaaatgccgttagaaatccaaaccggctgattcggcatattgatatggcggatgaaaaagaaaagaaacgggtgttaactgcgtttaaccatacagaaacggctgaaccgccggccccgacgcttcacgggctgtttgcccgccgcgccgcgctttcgccgcatcgtccggcgctccgttttccgggcggtatgctgacgtacgctgagcttgaccagtacacagacaggctcgccgttcggctccgccaaaaaggcatccgcaaagaaagcatggtcggcgtactcgctgaacgctcgccggagatggcggtttcagtgcttgccgtgttaaaagcgggcggcgcctacgtgccgcttgacccggagtatcctgaggacaggctgcgatatatgcttgaggacagcggcgcttgtctcctgcttgcacagccggggttatccgtttccggtttttccggtgaaacgctagaagtgtctctttcttctctgacaaatgagacggagacaggggctgtctctgaagaagcggatgctgattcgctcgcttatatcatttatacgtccggttcgacgggaacaccgaagggagtggctgttgaacaccgtcaagccgccgcctttttatcagggatgcaagggcagtttccgttaacggaagaggatattatcgtgctgaaatcatccttttcattcgacgcctccatctggcaattgttttggtggacgatgtccggcgcctccgtgtatctgcttccggccggctgggagaaagatcctgtgcggatgattgaagcgtttgcctcagaaaaggtgacgaccgcgcattttattccggcgatggtcaacagctttttagacgcgctggaaacagagcctgcggaaacaagaacacgcctcggcagaacactgacacgcgtgttcgccggaggggaagctctttccccgcttacggctgcccggtttgccgatcttctgccggagaccatgcttattcacggctatggaccgacggaagcgacggttgatgcggcgttttacgtctgtgaccgaaaacgggacagcggacggacaaggcttccgatcggaaaacccgttccgggtgcccgtctgtatgtattagatagcggaggaaccatccagcctgcgggcgtggcaggagagctgtacatcgcggggaccggcgtggcccggggctatctgaaccgccctgagctgacggaggagcgctttgtcgttgatccgttttatccgggagaacgcatgtatcagacgggcgatatcgcacgctggacagaagacggccttgtcgaatggctcggtcgttcagacggacaggtgaaagtccgcggctaccggattgaaccgggggaaatcgaagcggcgatccggcacatcgacggcattcgtgaggcggcggtcaccgcccggaccgaacacggcgaaaccgcgctttacgcctatattgaaggacgaaaaagcgatgacgtgcgggcggagcttgcgacacgccttccggcctacatgatgccggctcagtttatagagatgagcgaatggccggtcacgccaagcggaaagcttgaccgccgcgcgctgccggctcccggcggatcggcagacagacaggcgtacactgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaggacatcttcgcccggccgacggtggaagagctcgcttcggttattcaggacttggaagaaagctcgtatgaagcgattcagcctgcgcaaacacaagatacctacccggtgtcttcagcgcagaaacggatgtatgtgctccaacagcttgaagacggcggtgtcggctacaatatgccggctgtgctggaactgacgggcccgcttgaccgtgtccggctggaggagacgttccggcagcttgtggagcggcacgagtcgctcagaacgtcctttgaaacggggcctgacggcgaaccggtgcagcgcatccatgacagcgtgccgtttcagctcgatgaggccgagtcagctgacgcattcgtccggccgttttgtctggaggaagcgccgctcttccgtgcggccctcgtgaaagaatcggaagaacaccatcttttattaacggatatgcatcatattatttctgacggtgtgtccgtcaacaccttgataaaagaattcggcgagctgtacgcaggccgttcgcttgcgccgatgcgccttcaatataaagactatgccgtctggcagcggtcgtttcaggagaaagaaggatatcagaagcaggaagcctattggctgaagcggcttgaaggagagcttccggtgcttgaacttccggctgacaagccccgtccggcggtcagaagctttgcgggcggcagcgtatcgtgcacgcttgacgctgacacggcatccggccttcaccgcatcgcccgggatcacggctccactttgtatatggtgcttctcgccgcgtacaatacgctgctcgcgcgattgagcgggcaggaagacatcatcgtcggatcgccgattgccgggcgcccgcacaaagaccttgaaccgattctcgggatgttcgtcaacacgcttgccatcagaacggagccgaagggggacaaacggttcaccgattatttggcggaagtccgccaggcggcgcttgaggcgtatgaacatcaggactacccgtttgaagagcttgtggagcggctcggcgtgcagcgggacatgagccgcaatccgctgtttgatgtgatgtttattcttcagaatatggagcgggaggagataaatctggccggtctgaaggcgtcacgatcaaagcataccgaacatgatgtatcaagttttgacctgaccttatcagcggctgaatccgatggaaacatccgctttgagatggaattcagcaccgagctttttatgaaagaaacgattgaacgctggatgggccacttactgaatctcttgcgccatgttgccgccgaaccggaagtcacactatcgaaagctgacattttggatgaagaagaaaaacaaaagttactgattgagtttaataacacacaaaccgaattcatggaaaaacacaaactgtttcaccagctgtttgaagagaaagcagaagaaacgcctcatcagaccgctgttattgaaggagcacaacagatcagctatttccagctcaatgagcgggcaaaccgtcttgcccgaacactgcagaaaaatggattcggtccgggaaaaagagcagccatattagcaaaccgttcgattgaagcgatcgtcagtgttcttgcggtcatgaaatcaggaggagcgtatataccggttgactcccattatcctgaggaacggattcgctatttattaaaagacagcgcggcatccgtcttgatggtgcagtcagaatacaaagaacttgcttcacagctgacggatcacaatttatttctcattcagcttgatcatgaagatcaatacgatatttccgcaaagaatattcagccgacagcgtcaccggatgataccgcatatatcatatatacttcgggaacaacgggaacgccgaagggagtcgaagtcagaaatcgcagctttacgcatgcagcacttgcatggcgcaggatttatgagcttgatcttataccggtcagagtgctgcagatggcgagtttctcatttgatgtattttcaggggatctagcacgcgccctgctaaacgggggaacgcttgtcatttgtccggatgacgtccggcttgagccgcagcagctttatcggctcattgatcagcaccgtatcacgtttatggagtcgacacccgcgctgattgttccgtttatggaatatatataccgccggaaactcgcgctgcaaagcgtaaaaatactggtacttggttcagatatgatcaagtcgcaagatttttatacgcttcatgaacgctttgggaaagaaatgcggatcattaacagctacggtgtaacagaagcgacaattgactcttcgtattatgaagccgaaatgagcgaagagccgcgggaagatgatgtgccgatcggtgttccgcttccgaatgtgcaaatgtacgtcttaaacaaagacaaacaggtccagccgatcggcgttttcggagagctgtatatcggaggcgccggcgtcgccaaaggatattggggacagcctgagctgacagaggacgcattcagtgacccgttacaaacgggagaaacgctttacagaaccggagatcaggcttgctggctgccggatggaactcttcgttttaaagggcggatcgataagcaggtgaagatcagaggctacagaattgagacgggagaaatagaaagtgtgcttttgaaacacgatcaagtcaaagaagcggctgttaccgtgatgaaagatgccgaaggacaagcacgattagcggcatacgtcgttcctaaagaggccgatatctcatcactccgccagtctcttatgcaggagctcccggcttatatgatgccgtctcatattatcggtttagacagcatgccccttacactgaacggcaaacttgataaatcggcattgccggcagaagagatacattcatcacaggcatttgtcgcgcccggcgatgaaaaacaggcgatgttatgccggatttgggaagatgtgcttcatattcagaaagcgggaattcatcactctttctttgagcttgggggagattccattaaggcgcttcaagtgtcagcccgactcgccggagaaggctggaacatgtcgatccgcgatttgtttcagttcccgacgattgcagaactcgcgaagcacctcacgccggctgttgcaacggctgatcagggcccgatagaaggaagcgctccgctgacaccgatccagcagagattttttgaggagccgggtgcgtttgagcttcattataaccaatcagtcatgctgtgcagtgaagacagcctcgaaatagatgcgctgtatcaggcggtttgcgcgctgacagaacatcatgatgcgctgcgaatgactttcactgaaaatgagcatggggaagttgttcaatataaccgcggaatcacagagcagcatgaagaaatctttacgcttaacgtcatagatctttcagaagaaacacagccggaaaaacggatagccgctgaggaaaaagaaatacagcaggctatgcgccttgatcaaggccctctgcttcatctcggagtgttcaggctgaaagaagccgaccatctgctcatcacgattcatcaccttatcacggacggcgtgtcgtggagaatattgcttgaagatctgcagacagcatatcagcaggcattggacggcaaacaaatcgaactgccgccgaaaagcgattcttatataaagtatgccgaagagctttttgacatttccaagagcaaagcattgctggaggaagccgcatactgggacagcgtgatgtctggtgaaacagcgccgctgccgaaaataactgatgaaaacgccggacgattgcaggaaaacgcgcgcactgcatcatggatattaagcagcgaagtcacgaagcagctgctgatggaaacacagcaggcgtacggaacggatgttcatgaattgcttttaacggcgcttggaatgacgcttcatgagtggacgggttccgaacagatccttatcagcactgaaggacacggacgccaggggcatattcctgacattgatatgtcaagaacggcgggctggtttacatctgtttacccggtgcttttggatatgagagtgccggacggctcaggggaaacaaccgcgcaccgcataaagacggtaaaagacatgatgagacgggttcctcatcacggaaccggctacgggctgctgagatattcgcgaaacattctttataaagacccagaaataagctttaactatctcggtgcgtttgacggtcttgaggggacgctgaagatgtcaccgttcaagccgcagcatgatatagcggccgggcgcatccgcgagtttgatctggatattaacgcgatggtggcggccgggcaactggaggtaaaagccgtttataccgatgtatttgcaccgggggcaatcgagttcttcatgaatcgtttccatactcacctcggggacatcatcgcccactgttccggcaagaaagagcgggaaaaaacattaacggattacagccatacagaattgaccgctcaagccctatcaagcattgaagatctcgtaaaaggactttaatttcataaaaaggtgtgtggcattcgtgacacaagcgacagaaattcaagatatttaccctttatcatatatgcaggaaggcatgctgtttcattcgcttctggattccggatcaaacgcatatgttgagcagatttcgtttacagtcagcggggatttatgcattgatacattccaaaaaagtctggatatgcttgtcagccgttatgatattttcagaacgattttcataaaagaagtgcctgaccttgaagggccgcagcaggttgtcctttcacgccgtgacactgccgtacggactgaagacatttcagattattcggaagaacggcagcaaagcatcattgacaaattcaaggaaaccgaccggcataaggggtttgatctgcaaaaaggccccttaatgcgcctgactctttttcaaacgggagaaaaccgccatacgtgcgtttggactcatcatcacattatgatggacggctggagcttgggccttgtactgaaagatttcttcagcatgtattatgcgatccggagcgggcggcctgtaaacctcggcagtccggctccttacagcacttatatcaaatggctccgaagccggaataaagaagaaacgtcagcattctggtcgcgctgcttggaagattacggagaaaccgtttccgttccgcaaacgaagaataagacggcgcaaaacggttatgcatctgagcatttccaattttcccttgagcctgaaaccgtacaaaaactgacagacattgcccgaggcatcggggtcacgctgaatactatatttacgggcatttggggtctgcttctccatcgttacaacgggactgaagatgccgtcttcggttcggttgtttccggcaggccttcagctatcagcggcattgaatccatggccggactgtttatcaataccgtgccggtaagggtgcgcgcggctggtgatatgactttttcttctcttctcaaaaaggtgcaaaaagagtcactcgctgcggaagagcacagctattatccgctttatgacattcaaaacgagagcggcctgcaaaaagatctcttgaatcacatcctggtttttgaaaattatccggttcagatgcaggctgcggtaaacggctggcagcaaacggaaagccatgcgctctcacttgaaaacttttcgatggcggaggaaaccaattacgatcttaacgtcgtcatcgttccgggagaagagttttatgtgaaattcagctacaatgcgggcatctacgatcgggaagacatgaaacggatcaaagggcatattctagaggtcatctcctgtgtaacggaagatccggacaggcttttatcaagcatcagtctcgtaccaccggaggaagaagccctgattcattcgtttaacgaaacgaaccgtccgtaccctgagacaaccgttcatgggctgtttgaagaacaggcggcaaaaacgcctgaccaagaggcgttgagatataacggggtaagctggagctacaagaaattaaatcagcgggcaaatcagattgcccatgcgttaagggaaaaaggcgcccgttcagatcagatcaccgctgttatgctgcgccgatcaatgagtacggttgccgctctgctcggaatttggaagtcgggcagcgcctatatgccgattgatgcggaatttccgcctgaacggatttcatttttactgagagacagtgaagcctcactgctcctgactgaaaaagacctgctccccctcattccgccgcatttcaaggggagcgtcgtcatcatggaggaaacggtttcccagcagactgcaccgcttccgccggtgtctgacagcggaaattgggcgtatgtcatttacacttccggaacgacaggccggccgaaaggggtgcttgtacaacacaaagcgatcagcaatacattgcaatggcggcgtgaagaatacgggatgacagaaggagacatagcgcttcatcttttttcatacgtatttgacgggtcattaacgagtcttttcactccgcttctgtcgggcgcctgtgtactgttaactgatgaagatgatgcgaaagacgtcctttcaataaaacagaaaatcgcccgccacggggtaagccatcttctgatcgttccgtctctgtatcgcgttctgcttgattcgctgacgaaaaaggatgcgcagacgcttcgggcggtgacatttgccggggaagcggccactcctgatatcgtggaagcgagccgcaacatatgcccgaatgccgagctgctgaatgaatacggcccgacggaaaacagtgtggccacgacgattctgcgcaacctgcaaaaaagcagccggattacgatcgggcgcccgattgccaacacttctgtctatatgatgcacggagatcggctgcaaccggtcggagccgtcggtgaactgtgtatttccggaaaaggtctggcggacggatattttcagcaaaaagagctgacggacaaagtctttacccctcatccgtttcgtaaaggtgaacggctgtacagaacgggagatgcagcccgatttttaccggacggaacgattgaatatatgggacgctttgacgatcaggtgaaggtaagaggttacagaattgaattaggagaaatcgaaacggcactcagaagtctgtccggggtaaaagaggcggcagtcatcgtgcgcaaaacggcggacggggaacaggagcttgcagcttatgccgtactggaaaacgcgggtgtgacatttgatcctcatgccgaattggccgggagattacctgcttatatgatcccgggaagctttaccaaattgacggaaatgccgctgtctgtgagcggaaaacttgaccgggccgcacttcctgagccgaaagaagccgagagaaccggtgattatcaagctccgcgcacaatgcttgagactgagctgctgtctatttggcaagaagtgctgaaacgggaacacatcagtatgagagatgatttcttccaaatcggcggacagtcgctgaaagccgcgtcgcttgtttcaaagatacataaacggctgcaaattgaacttgccgtccgccatgtttttgaacatccgaccatcgagagcatggcccgcttcctagaacagaggaaaagaggagaatatgcagaaatcacgcctgcggaggcaaaggacttgtacccgctatcttttgcgcaaaaaaggctttatgcccttcatcagcttgcggcggacagtacgggctatcatatgcccgcttgtctggaactgagcggcagactcaaccgtgatcgtctgcacgaagccttttcagcgctgttacaaaggcatgaagcgttacggacatcatttgttttacgaaacggggagccgatgcagcacgtacattcacatgtcgatctcgatctcacagagattcacatgccatccgggacacttcttcaagaggcgatggaaactttcgtcaaaccgtttgacgtggaaaaagcgccgcttttgagagtgactttagccaaagccactgaagaacgtcattttctgctgcttgatatgcatcatcttattgcagacggtgtgtcaatgagcgttctgatccaagaattgacggatttgtacagaggaaaagagctgcggccgttaaaacttcagtacaaagatttttccgtctggcagcatgagcggttcgccgctgaagaattcaaaagacatgagcggtattggctggatgcgatcggggaaaatattccccttcttgatctgccgctcgataaaaagcgcccgcagcttcctgatttcagcgggtccgttgttcgaacgcgcctacaaaaagaaacggcggagaatttgcgccggctcatggatgagacgggttcgacactgtatatgattcttttggcaggctactccttgttcctttctaaattgagcgggcaggaggacattgtcgtcggttcacctgcggccggcagaagccgcgctgagcttgatggggtcatcggcatgtttgtaaataccgtggcaatgagaagcaggccgaaaggggataaaacattccgcgcttatttagaagaggtgaaaatgctcgccctcggcgcagccgaacatcaggacttcccgtttgaagaacttgcccaaaagcttgatacacaccgggaagtcaatcgcaatccgctgtttgatgccatgctcgttttgcaaaacagtgatgatttcaaagtgaaccttccgggcttatccgtttcttcacatgcagtgaaacatgacatttcaaaattcgacttgacgcttcatgccgaggaacggccggacggctcactggattttcattttgaatacagtaccgcgttgtttgaaaaaggtacgatcgaacggtgggccggtcattttaaagagcttttaggacaaatcgcatcggatgatgagcggaagctgtctgacattcatttgctggacacaaatgagcggcagatgcttcttcaagcggaaaatcaaacagctgagtatccgaggcatgagacgatcgtcagtttatttgaggcacaggcggaaaaaatgccggatcaaattgcagccgttatgtccgatgagcgtctcacctaccgcgagctcaatgaaaaggcggatcgaatcgccgatatgctgtcggaaaacggcatccgctccggacagattgtcggaattatgaccgaacgatctcctgaaatgctgatcgggattttcggtattttaaaagcgggaggagcttatctgccgattgatcctgactatcctgacgagcggatttcatttatgctgactgacagcggcgcgcgtgttctgttgacgcaatcgggtcttgggatatccggaatggacgggctgccggttttatacatcgataagcctgaatccgtttcagcagacagaacgaaagaaatgataacgcctgaacagccggcttacgtgatttacacatcgggcacaaccggaaaaccgaaaggcgttatgacggagcaccgcaatgtcatcagccttatcacacataaaggactgccgtttgatttcggcactggagacgtctggaccctgttccactcctattgctttgatttttctgtctgggaaatattcggcgcgctcttatacggcggaaaggtagttatcgtgccgaaagaaactgcccgtgatccgcatttgtaccggcagctgctgcaaagtgaaggcgtaacggtgctgaaccaaacgccgacggctttttccggactcattcatgaagaagccgggcatgcggacaagctgaagcttcgatatgtcattttcggcggagaagcgctccagcccggcatgctgaaaagctggaaagagaagtacccggagacagagcttgttaatatgtacggcattacggaaaccacggttcacgtcacatgcaaaaaactgaatatggatgatattgagagaaataaaagcaatatcggcagaccgctggaaaccctccatgcttttgtcatggacgcctatatgaatccgcagccgatcggaattccaggtgagctttatatcggcggggaaggcgtcgcgaggggatatgtaaacagggatgatttaaccgcctcccggttcatcacgaatccgcacattaccggcatgcggctctaccggacgggcgatattgccaaaagactctcaaatggcgagctggaatatgtcgggcggaaagatgcgcaagtaaaagtcagaggccacagaattgagctgggagaaataaaatcagcgctgcaggagctttccttcgtgaaagaggccgccgtgatcacacgtgctgatcagcacggtcagcactccatttacgcatacgcggtcttacacgggaatgaaaaaataaaagaagcagaggttcaggcctctctcagagcttttctgccggaatatatgattcccgcccgcttgatagagcttgatgaactgcctttgacggcgaatgggaagctggacgagaaggcgctcccgcagcctgaattaaatgaaagccttggagatgatatcagcctgagaaatgaaactgaagaaatgatggctgacatctgggaagaactcttaggtgttgaaggactcggccccaatgctcatttcttccatctcggcggggattcgattaaagcgctgcaagtatgtgcgaggctgaaacagcagggctatgaaacgaccgtccgcgagctgttcgagcatcagacactgggagaagtctcgatgcggctccggaaagtccgccgcgtgattgatcaggctcccgtcacgggagacgtgccgctgacgccgatccagcactggttcttttcgcaatcattgccgcatgatcattttaatcagtccgttatgctcagcagtgcggacaggatcaatgaatctgctatgagaaaagcgctggcacagctcgcggttcatcatgacgcattacggatggtatgcggcacgcaaaacggatcagtgattcaatataacagagcggataacctttctgaagaagaactctttacatttgaaacgcatgacgtgagagggaaagggttattacaagaggaacacgccgcaattgaacaggcggccgcccgcattcaaacttccattcggctggagacgggtccgctcgtagctgtcggtttatttcacgctaatgatggcgatcatctgctgctttccattcatcaccttgtcattgacggagtgtcatggcggattttatttgaagatctcaccgcgtgctacaggcaggcgctcgaaggaaaagaagccgcgcttccggcaaaaaccgattcctatcagacttacgcgaagcaaatctctgattatgcaaaaagccgccggctgttacaggaagcagactactggtccgaaagagaaaaagcggcggtcaaaccgcttccgaaagatgcccgcatctcttccaatcttctgaaagatacagatgtgatgaccgttacattgacaaaacaggagaccgagcagctgttaacggaagcgaacagagcatacacaacagagacgggcgaattattgcttgccgcgttaagcctagcgctgaacagatggaccggaaacgagacattcaaaatcagcatggaaggccacggaagggaagagcacctggagcatcttgatatcagcagaaccatcggctggtttacgtcaatttatccggtattggttgacgcaagttttcaagatcagcctgatgacggcgagcgtctcggctatcacattaagcggacaaaagacatgatgcgccgcataccgcataaaggagcgggatacggggtgctgaaatatataagcaaactctggggagagactgaatctgattctcctgaaatcagttttaactatctgggacagtttgaccgggaaatccgttccagcggcttcggtgtttctcccgtaaaagcgggaaatgaagtcagcccagactgggaacgtccgtacacacttgatatcagcggctccgtatcgtcggaatgtctcagcatgcatgtcgtgtacaaccgttttcagtatcaaaaagaaacgattgaagttttgacgggatattttcatacctttctcaagcagattatcacgcattgcacaggcaaagaggagcgtgaatggagcgccgctgatttcagtgacgaggagttaacgctggaagatctgagtgacattatgggagccgtcaacaaactatagaaaaggagtggcgcaatggggcagcaaccggaaatacaagatatatatcctttgtcttttatgcaggagggcatgctttttcattctctgttggatcatgactcaagagcctacttcgaacaagcggtgtttacgatcagcggacagcttgaccgggaacggttccaaaaaagtatagacactgtttttgaacgatacgatattttccgtacgacatttattcacaagaatgtggcaaagccccgccaagtcgtgttgaaaaacaggccgagccgcgttcagtttcatgatatttctcatttggacgagaaggcacaagacaaatatgccgaccggtttagaaaagaagataaagataaaggctttgatttgcaatcagaccctctcatgagagtctccattttgaaaaaagcgcctgaacgctatgtttgtatatggagccatcatcatattgtcatggatggctggtgcttcggaattgtcatgaaggaatttctgatgatctatcaatctctcggagacgaacggcttccgttcctcgagcccgttcagccatatgggaagtatattaaatggctcatgaagcaggatcgtaaagaagccgagattttttggaaaacgagacttgccgatcttgagcaaacggcgtctcttccgaaaaaatccgcggaaccaaacggcgaacttgagcaggcggttttcaccatttctgaagagcagacaaatgagctgaagaacattgcggcaagggcgggagcaacgctgaatacagtgttccaggcactgtggggcattttgctgcagcgtgtcagccgctgtgatgatgccgttttcggttctgtcgtttccggccggccgtcggatctcgcaggcgtggaaaaaatggtgggactgtttatcaatacgattcccgtacgggtgaaaagcggttcattttcttttctggagcttgtcaggcatttgcagcaggagacgctgcaagcagaagcgtacagctattatccgctgtatgacattcaggcgcaaagccctctgaagcaagcgctgtttgaccacattatcgtgtttgaaaatgtgccggcccagcgtgaaattgaaaatgtgagtcaggccggttcatttgattttgcggtagaggattttacgatggaagaagtcacaaactacggatgcagcataaaggtgattccgggcaattctctttatatccgcttaaaatttgataccggtatatacgacgatgtttttatgaagaatatcgaaacatttttacggcatatggtgaactcagtcatttccgaccctgaaatcggcgcttccgagatcgcattgctggatgcgtgtgaagccagaagtatgatggatgcatttaaccatacagaagcggttgaaccgccggctccgacgcttcacgggctgtttgcccgccgcgccgcgctttcgccgcatcgtccggcgctccgttttccgggcggtatgctgacgtacgctgagcttgaccagtacacggacaggctcgccgtccggctccgacaaaaaggcgtccgcaaagaaagcatggtcggcgtactcgctgaacgctcgccggagatggcggtttcagtgcttgccgtgttaaaagcgggcggcgcctacgtgccgcttgacccggagtatcctgaggacaggctgcgatatatgcttgaggacagcggcgcttgtctcctgcttgcacagccggggttatccgtttccggtttttccggtgaaacgctagaagtgtctctttcttctctgacaaatgagacggagacaggggctgtctctgaagaagcggatgctgattcgctcgcttatatcatttatacgtccggttcgacgggaacaccgaagggagtggctgttgaacaccgtcaagccgccgcctttttatcagggatgcaagggcagtttccgttaacggaagaggatattatcgtgctgaaatcatccttttcattcgacgcctccatctggcaattgttttggtggacgatgtccggcgcctccgtgtatctgcttccggccggctgggagaaagatcctgtgcggatgattgaagcgtttgcctcagaaaaggtgacgaccgcgcattttattccggcgatggtcaacagctttttagacgcgctggaaacagagcctgcggaaacaagaacacgcctcggcagaacactgacacgcgtgttcgccggaggggaagctctttccccgcttacggctgcccggtttgccgatcttctgccggagaccatgcttattcacggctatggaccgacggaagcgacggttgatgcggcgttttacgtctgtgaccgaaaacgggacagcggacggacaaggcttccgatcggaaaacccgttccgggtgcccgtctgtatgtattagatagcggaggaaccatccagcctgcgggcgtggcaggagagctgtacatcgcggggaccggcgtggcccggggctatctgaaccgccctgagctgacggaggagcgctttgtcgttgatccgttttatccgggagaacgcatgtatcagacgggcgatatcgcacgctggacagaagacggccttgtcgaatggctcggtcgttcagacggacaggtgaaagtccgcggctaccggattgaaccgggggaaatcgaagcggcgatccggcacatcgacggcattcgtgaggcggcggtcaccgcccggaccgaacacggcgaaaccgcgctttacgcctatattgaaggacgaaaaagcgatgacgtgcgggcggagcttgcgacacgccttccggcctacatgatgccggctcagtttatagagatgagcgaatggccggtcacgccaagcggaaagcttgaccgccgcgcgctgccggctcccggcggatcggcagacagacaggcgtacactgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaggacatcttcgcccggccgacggtggaagagctcgcttcggttattcaggacttggaagaaagctcgtatgaagcgattcagcctgcgcaaacacaagatacctacccggtgtcttcagcgcagaaacggatgtatgtgctccaacagcttgaagacggcggtgtcggctacaatatgccggctgtgctggaactgacgggcccgcttgaccgtgtccggctggaggagacgttccggcagcttgtggagcggcacgagtcgctcagaacgtcctttgaaacggggcctgacggcgaaccggtgcagcgcatccatgacagcgtgccgtttcagctcgatgaggccgagtcagctgacgcattcgtccggccgttttgtctggaggaagcgccgctcttccgtgcggccctcgtgaaagaatcggaagaacaccatcttttattaacggatatgcatcatattatttctgacggtgtgtccgtcaacaccttgataaaagaattcggcgagctgtacgcaggccgttcgcttgcgccgatgcgccttcaatataaagactatgccgtctggcagcggtcgtttcaggagaaagaaggatatcagaagcaggaagcctattggctgaagcggcttgaaggagagcttccggtgcttgaacttccggctgacaagccccgtccggcggtcagaagctttgcgggcggcagcgtatcgtgcacgcttgacgctgacacggcatccggccttcaccgcatcgcccgggatcacggctccactttgtatatggtgcttctcgccgcgtacaatacgctgctcgcgcgattgagcgggcaggaagacatcatcgtcggatcgccgattgccgggcgcccgcacaaagaccttgaaccgattctcggggtgttcgtcaacacgctggccatcagaacggagccgaaaggagacaaacggcttaccgattatttggcggaagtccgccaggcggcgcttgaggcgtatgaacatcaggactacccgtttgaagagcttgtggagcggctcggcgtgcagcgggacatgagccgtaatccgctgtttgacgtgatgtttgtgctccaaaatatggagcgtgaatccctgaatttaaatgagctgcatttgactcaagccgcggatgcaggtcataaaaccgcaaagtttgatgccacgctttacgcggcagaagggtctgacggttccatcagctttgattttgaattcaatacagatatctatcaaaaacagacaatcgaaaaatggctttcttattttacccgtattcttacaaaagtaattgaagaccaaacaataccgcttggtgacattcacgtactggatgatgctgaaacaaatcgcgttatttatcagtttaatcagacgaaaagcgattacccaagacacgaaaccatcagccgtttatttgagcggcaggctgaagaaacccccgatgcccgggcagttgtatatgatggacaaatcttgacataccgtgagctgaacgaacgggctaatagaatagcggcggctctccgatcaaatggcgtcggtccggaaagtgttgtcgccttattaaccggacgtacaacagagcttgcttccggaatcctcggaatattaaaagcgggaggcgcctacttgcctatcggtgacgatgtgcctcgggaacgggctgaatggatgcttaaagactgtaaagctgatattcttctccaatctgataaacttgacggtctgccgctttccggaaaacgtttattcatagaggatattcaaacaaaggccggcttaagttcggaaaatcccgaaccgctcggcggacctgaatcattggcctacatgatttatacatccgggtcaacaggtgcgccaaaaggcgtcatgattgaacagcgaagtgtgatccgtcttgtgaaaaacagcaattatattgattttacgccgaaagacagactgttgtttacttcatcattaggatttgatgtaacgacatttgaaatattcggtccgcttttaaacggtgcttctttatatgtaagtgaccaggaaacctatctcgactctgatgttctggaaacatttatacagcaaaacggcattacgacactgtggctgacatcgtctttgttcaatcatctatcagaacaaaatgaacacgtgttttccggattatcccgattgattatcggcggggaagcactgtccccaagtcatgtaaaccgggttcggaaaacgctgccgcatctttcaatatggaatggatacggaccgactgaaaacacgacgttctcgacttgctttttgattgaacaatcatacgatcattcaatcccgatcggccgccctgtcggaaattcaactgcatatatcataaacagcaggggaacaccgcagccgatcggcgtcatcggtgaattatgcacaggcggagacggtgtggcaagaggatatttcggccgccctgagctgacggaagaaaaatttgtccctaatccttttgttcccggagaacggatgtaccgcaccggggatttagcccgctggctgccggacggaacgattgaatatgccggacggatggatgatcaagtgaaaatccgcggttatcgggtcgagctgggagagattgaagccgcactaaggagcctggacggcgtgaaagaagctgccgtgtcagtcagaaccgggcagtccggcaataaagaactgatcgcatatatgagtctgcaggcggacatggatacagaaaaagtgcgttcttcactttctaagcaactgccgaattacatggtcccggcctatatgatggaacttgagaagctgccgcttacgccgaacggtaaattggatcggaaaaatctgcccgaaccggagctcgcgcttcaaaccgcgtacacagctccccgcaatgagcttgaagaacagctttccgtgatctggcaggaagtgctcggcacaaaacaagtcgggattgaggattcattttttgagttgggcggcgattcaatcaaagcgctccaagttgccgcacggctcggacgctatgggtggaaaatgacggcaagtgacttattccggcatccgtccattaaggaactcgcgcctcttatccggaaagcggaaagagtcatcgatcagcaaccggtggaaggagacataccttggacacccgttcagcactggtttttatcacagcggatggaaaacagaaatcatttcaatcagtccgtcatgatgttcagctctgacgcattgcataaacagccgctcaaacaagccttggagcatcttgtcattcatcatgatgcactccggatcaccgtcagtgcagaaaacgaaagtatcagacaaatcaatcacggtattcaaaaagatgaactgtacagcttggacatttgggatctgtctgagacagatacttgggaaagagaaatagaagatgaagtggctgcgctccaacagcggatggatattgaaaaaggaccgttattaaaagccggctggttcaaaacccggtcaggggattatttattcatcaccgtacatcacctggcggttgacggagtgtcatggcgtattctgctggaggatttatctgccgcttacacacaagccgtaaaaggtcagccggtccagcttccgccaaagaccgattcgtttaagcaatacgccgtaaggctttcagaatacgcaaaaagcagcaagctgatgcgtgaagaagaatattggcgttttattgaagaagaaacagccgccggacttccttatgaaaaaccgcagtatcagacgggagccgacagcattcggcaaacggtaagctttacgcttacagaagaagaaacgtccgttttgcttcagcaggtcaaccgggcctaccataccgatacgcaagatgttcttctgactgccgcagctttggctttacgggactggacagggggcggcagactgcgcatcgcgatggaagggcacgggagagagcacatcatgccggagctcgacatcagccgcaccgtaggctggtttacctccatgtacccggtgctcattgacttgaacacagcaggcgctgagcttggaacggctgtaaaaacggtcaaagacacactcggaagaataccggataaaggaataggctacggcattttaaaatacatgacaccgcctgaacaaaaaacaatccgcttcagacaagcgcctgaaatcagttttaactatttagggcaattcaatgatacagaagatcagcccacattcagtttatccggtcttgcgagcgggcacgacatcacgccgacatggcagcgggaacaagcggtggaaatgagcgcgatggccgctcaacataaactgcacttcagtttgagctatccgccgagccgcttccgcaaagaaacgatggaacagctgctgcaaaccttacagcaatatttgcgtgatattatggcgcactgcacaggcaaagaggaagcagaaaaaaccgttagtgattttagcagcaaaacgttaacatctgatgatttggacagcatagcgagttttgtcgaggaactgtagaaaaaggcgacggggagattataacatgacaaaaaagaatgcaattcaggatatttatccgctgtcttatatgcaggaaggaatgctttttcattccctcctgcaaaaggaatcacaggcttacgccgagcaggcctccttttcaataacggggaaggttgacacccgcgtgtttgaagagagcgttcatgcccttttcgaaagacatgatattttcagaacgatctttatcagccagaacgtgtcagtgccgcagcaggtcgtattaaaagagcggaacgtcagcatcattgaggaaaatctcaccaatttaaacaaggctgatcaaatcaagcatattgaagaagccaaacgaagagaccgaaagaaaggatttcacctgcaaaaagacatgctgatgcgggtgacgctgcttcaaaccggtgaatgtgaatatacgtgcatatggagttttcatcacattattatggatggctggtgtctcggaatcgtgctgaaagagttcttccagatatacgcctcgcggctccgccggacaccgttaacgcttgagcccgctgtgccgtacgggacctacatcaagtggctgatggagcaagataaagaaaaagccgcttcgtactgggagcgataccttgaaggctttgagcagcagactgttctgccgaagcagaaaaaagccggcgaaagcagccaagaggaagtgacgttttccttttcaaaagaggacacagctaagctgaaagatctggccgtgaaagaagaggtcacgctgagcaccatttttcacacgctctggggcattttgcttcaggcgtataaccagacagaagatgcggtttttggttctgttatttccggaaggccgtctgaaatcaaaggcatcgagcgaatgatcggcctgttcattaataccgtgcctgtccggatcagcggggcggacattccgtttcaaaagctgatcaaaaacgtgcaaaaggacgctttgaaaggacaggcatacagctatcatccgctttatgatatacaggcgaattcacaggtaaaacaaggcttaattgaccatattctcgtctttgagaattatccggttgaacaggagcttgatgtactgaacagcaagggggacacgaaagacctttttcacatccatgatttcagcatggaagacgaaaccaattacagtttttacctgatggtggcgccgggtgacgagattcacttgaaaatgagatacgattcaagcatgtatgaccgccaatttatcgaaaatatcaaaggtcatttgacacatatcgtttcccagattctcgacaaacctgatatcacgccggataagcttgtaatcatcactcctgaggaaaaagagcagctgcttgcgccgatttctgaagagactgaaaagcctgagtatgacacgattcatgcgatgtttgaacggcaggccgcacaaacgccggatcaaatcgcgatccggtatgaaggcgggtcagtgacgtacaaagagctgaatgaatcggctaataagctggcccgtctgctgcaaaaacgcggattaaagcgggaggagccggtaggcgtcatgctcggccgttctccttctttagcggcggccgttctcggtattttaaaagcgggcggcgcctttgttccgatagatccgggcagtccaaaggagcgtatccgatatgttattgaaaacagcggctgcatccatgttgtaacagagcggcatcagtcactccccgcggaacaaacgctgcaggttacatatatagaagaggccgggacggaagcggacggaagcaatgtgcaatccattaatacggcggacgacctcctttatatgatttatacatccggtacgacagggaaaccgaagggcgtgctgctcgaacataaaaatatggccaaccttctttctgaccaattgacgaacacaggcattgatttttgcacaaatgtgctgcagtacgcatctttggcgtttgacgtctgctatcaggagttattttcagtactcttgagcggcggcaccctttgtatcgtgcccgaatcaatcaaacgggatgtttctcagctgtattcgtttatcgatcagcacaaaacggaagtggtgtttttcccgactgcgtttgtcaagatgcttttcaatgaagaaggttatgcacagtcttttccccgctgtgtgaagcatgtcattacggccggggagcagctgactatctcacgtttgttcaggcagacgctccgtttacacggtatgcagctgcataatcattacggcccgtcagaaacccatgtggtttcaacgtatacgatttctgcgggagatgacatacctgaacatccgccgatcgggaaaccgatccatcataataagatgtatattctcagcaaaaacagacagcttcagcctctcggaattgcgggagaattgtatatttccggagcgaatacaggaagaggctatgtgaacaatccggcgctgaccgaagagaaatttttgccggatccgttcagaaagggcgccgtcatgtaccggaccggagatttggcaagactgcgtgcggacggccaaatggaatacatcggccggacagatgatcaagtgaagatcagagggtaccggattgaaccgaaagaaattgaaaccgttctggcaaatcatcatgccgtgaaagaagctgccgtgctgattcaaacgaatgagtcgggcgaaaatgaattatgcgcctactgcagcgtctcacaagcgactgatccttctcagctgcgaagtgatttggccaaagagctgcctgattatatgattccggtcaaatgggctttcattgacgcgattccgctcactgcgaacggtaaagtcgatcagcgggcccttccggaagcttcggcgtacgcagcgggccgtcgatatacagctccccggaatgtgaccgagctgaagcttacccgcatatgggaagaagtgcttcaaaccggcccgatcggcgttcacgatcactttttcgagcttggcggccattcattaaaggcgacggcactcgttgcaaaaatagctaaagagtgcagcgtgcaaatcccgctgagtgatgtcttcagctatccgactgtagaagaactcgccaaaatcatcggtgaagcagaagagaatccgttcgcatccatagaaaagacagaagcaaaaggaacttatcctgtctcatccgctcaaaaacggatgtatgtccttcaccagcttgaaaatggcggtgtcagctataacattccagccgttttagaggtgaaggggccgtttgaccgagacaggatggaagccgtgttcaaggagctgatccggcggcatgaaccgctcagaacgtcctttgaagaaaaaaacggccggcctgtgcagaggattcatgacgaagtgccgtttgcatttacaaaagaacaatcagccgaagcgtttatccggccgttcgatctcggcaaagcgcctcttttccgggcgggatttgtccaaatagaaaaagaccggcatctgcttttagctgacatgcatcatattatttcagacggcgtatccgtcaatcttttgatacgtgaattcagtgagctgtatgctgagagaagtctgccgccgttacggattcaatacaaagattatgccgtctggcagcaatcatttaaggcgggcgccgcatatcggaaacaagaggagtactggctgaaccggcttgccggggagattcccgtgcttgaattgccggctgataagccgcgtcccccggtgcggagcttttccggtgaccgggtgtcatttgtcatcagcgaaaaacatacagcgcagttgaaaaagctggcgaaagaaaacaaatgcacactttatatgacgctgctcggtgtgtacacggttctgttagcccgtttaagcggacaggaagatatgattgtcgggtctccgattgcaggaaggcctcatgccgaccttgacgccgttctgggcatgtttgtcaatacgctcgctttcaggacgcgtcccgacggaagcatgacgttcaaagaatatttaaaggaaattcgccaaacagcgcttgaggcttacgagcatcaggattacccgttagaagagctcgtcgataagctcggtgtgccgcgggacatgtcccgaaatccgctgtttgacacaacatttgcgctgcaaaatatggaacagcagaagcttagggcagccggacttgaactgcagccggcagacgtcagcctgccgatttctaaatttgacttatcgctgtacatctccgaaaacgccggtgaattgtactgccagtttgaatacagcactgatttgtttgagagaaaaacgattcaaaaatgggcggaatttttcacgacacttgctgaaaacgccgcagctgatccgggtttggaattagacgatatttctgttttgtcagaaaaagaagaagtgtctctgcttcaaaatttcagccccttgcagaaaacagcgtttccgcttcatcagccccttcatgagctgctggaacaacaggcggaaaaaacgccggaccgtccggcgattttaactgatgagatttcgattacgtatcaggaactgaacgaaagagcgaatgagcttgcgcaccggctgatcaaacgggggataaggctggaggataaaactgccattatgggccggcgttctcctgacatgctgatcggcatttacgctgtcttaaaagcaggcggtgcatatctgccgattgatccggattacccggaagagcggattcgctttttactgaaagacagcggcgtgaaattcttactggcagaaccagaacttttcgcaccagatctttttaagggagaaacgatctctctgaaaagcggacaaacaggaaacccggaagctgcggccaaccccaatgttccggtaaagcctgattcattggcttatatcatctatacatccggttctacgggacgcccaaaaggcgtgcaggttgaacatcagtcagccgtaaactttttatactcgctgcaagcgcgttatggattaaaggattccgacaccattttgcataaaacatcatactctttcgatgcttcgatttgggagctgttttggtggccgatcgcgggagcttctgtttttctccttccgcaaggcggcgagaaagaccctgaaatgatactgaacgcattggagaaaaaccgcatcacggcagctcattttgtgccatccatgcttcatgctttcttggaatatataaattccagaaaacagccgatcaaaaagacctgcttaaaaagggtttttgccgggggcgaacaattgggcccgcacttggtttcccgtttttatgaccttctgccgggaacggaattgacaaattcctacggtccgacggaagcgacggtagaagcggcgtacttcgatttgccgcaaggaaaggaatttcacaatgttccgatcggcagttccggacataacatgcggctgtatattttaaatcaaaagaaacagcttctgccgccgggctgtatcggagagctgtatatcgcagggaccggcgtggcccggggctatctgaaccgccctgagctgacggaggagcgctttgtcgttgatccgttttatccgggagaacgcatgtatcagacgggcgatatcgcacgctggacagaagacggccttgtcgaatggctcgggcgttcagacggacaggtgaaagtccgcggctaccggattgaaccgggggaaatcgaagcggcgatccggcgcatcgacggcattcgtgaggcggcggtcaccgcccggaccgaacacggcgaaaccgcgctttacgcctatatcgaaggacgaaaaagcgatgacgtgcgggcagagcttgcggcacgccttccggcctacatgatgccggctcagtttatagagatgagcgaatggccggtcacgccgagcggaaagcttgaccgccgcgcgctgccggctcccggcggagcggcagacagacaggcgtacaccgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaggacatcttcgcccggccgacggtggaagagctcgcttcggttattcaggacttggaagagagcccgtatgaagcgattcagcctgcgaaaaaacaggacacctacccggtgtcttcagcgcagaaacggatgtatgtgctccaacagcttgaagacggcggtgtcggctacaatatgccggctgtgctggaactgacgggcacgcttgaccgtgtccggctggaggagacgttccgggagcttgtggagcggcacgagtcgctcagaacgtcctttgaaacggggcctgacggcgaaccggtgcagcgcatccatgacagcgtaccgtttcagctcgatgaggccgagtcagctgacgcattcgtccggccgttttgtctggaagaagcgccgctcttccgtgcggctctcgtgaaagaatcggatgaacgccatcttttattaacggatatgcatcatataatttctgacggtgtgtccgtcaacaccttgattaaagaattcggcgagctgtacgcaggccgttcgcttgcgccgatgcgccttcaatataaagactatgccgtctggcagcggtcgtttcaggagaaagaagggtaccagaagcaggaagcctattggctgaagcgacttgaaggagagcttccggtgcttgagcttccggctgacaagccccgtccggcggtcagaagctttgcgggcgggaaagtatcgtgcacgcttgacgctgaaacggcatccggccttcaccgcatcgcccgggatcacggctccactttgtatatggtgcttctcgccgcgtacaatacgttactcgcgagattgagcgggcaggaagacatcatcgtcggatcgccgattgccgggcgcccgcacaaagaccttgaaccgattctcggcatgttcgtcaacacgcttgccatcagaacggagccgaaaggagacaaacggtttaccgattatttggcggaagtccgccaggcggcgcttgaggcgtatgagcatcaggactacccgtttgaagagcttgtggaacggctcggcgtgcagcgggacatgagccgtaatccgctatttgatgccatgcttgtcgttcagaatatggaacatgaggaattgctgttggacggtttgcatattcagcctgcggacgtgtcccgtccggtttccaaatttgatgtcactttgcaggcttctgaaggcgggggacagattcattttctgtttgaatatgcggcgtctttattccggaaagaaacgatgcagcgctgggcttcccactttatgacgatgcttgaacacattgtccgtgaaccggaaacttctatacaagcgatcagcatgctgactgctgcggaacgggaccgaattctttcggactttaacggcatgacggataaacagctgcctgaaaaaacagttcatgaactgttcatcactcaggcgcgaaaaacaccggatgcggcagcccttatcagcggggaaacgttggtcacatataaagaattagatgaatggtcgaataaaatcgccagagctctgcaaaaacggcagatcggaccgaatgccgccgtcggcattgtgataccaagatcaccggaacaagtcgccgcagtcttcggggtttggaaagccgggggcgcctacgttccgatagatcctgaatacccggaggaacgcaagcaatatatcatttcagacagcggcacagcgcttctccttaccgtacacggcgcaatagatcaagtgcctgatcattttaaaggtgaagtgctcgcactggaggatatccaagaacaagacgcatcaccggttcagccattatcagcaccggaagatttggcttacatcatttacacgtccgggacgacaggcaggccgaaaggggttatggtcgaacatcgttccgtcagccaaacccttcaatggcgaagcggattttatgatctgaatgagaaagatacggttcttcagcttttttcattttcatttgacggttttgtaacaagtatgttcacaccgctgatttccggtgcgaaagcggccgttttagccgaagatgaagcaagagatattcttgccattaaacactatcttgcatcttaccgcatcactcatatgatcattgttcccgtactgtaccgtacactgcttgacgtactggagccgggggatgcagagtctctcagaattgtcacattagctggagaagctgtcgaccaaaacattatcagccgcagtttatcagtttgtcctcacacggagcttgccaatgagtacggcccgacggaaaacagcgtcgccactacagcggcaagacatatagaacaaagtgagaacattacgatcggccggacgattgagcattcacacgtttatattttaaacggggatcacccgcagccgatcggtgtaacgggagaactttgcatttcgggttccggccttgcaagagggtaccgcaatcttcctaagcaaacggcccaagcctttgtccaagacccgttccagaagaaccggcgcatgtaccgcacaggcgatctggcaaaatggctgccggacggcacgctgcaatatatcggccgaatggacgagcaagtcaaaatcagaggctaccgggtggaactgaaagaaattgaatcggccttaacaggcataaaaggtgtcaaagaagcagccgtcaccgctcataccgcatcagcaggccaaacggaactatgcgcttatatcgtgacagaagaaggaacagaaagtgaaaccgtgcagcaggcgctcagaaatgaaatgcccgcttatatggtgccggcgttctttgaaacacttgaagccctgcctgtcacaccgaacgggaagcttgaccgccgcgcgcttcctgagccgcggaaaaaagcgcacaccggacgggcatttacggagcctgaaagcgacatggaaaaagagctttccgcgatttggagcgaagtgctcggaactgaaaacattgccgcggatcaatcattttttgaactgggcggcgattccatcaaagccctgcaagtatcagcccgattacatcaggcaggaaaacagatcgccgtaaaagatattttcagccggccgacaattagagagctggcgccttatgtccgtacagagcggcagccggtcagccaagctcctgcagaaggagaagtgaagtggtcgccggttcacaaatggttcttcacacaagacatgaaggaagcaaatcattttaaccagtccgtcatgctgacgagaacaaattcaatagatgaagaggctctcaggaaaacgttaaaagccattaccgttcatcatgatgctttgcgccttgtctgcaaaaaagacgaagagaaaggtcttctcctcttcaacagaccggctgacctcgcagatgagcagctttacaacctgaccatattagaaacggaaggcgatgagcatgagaaggaacgttttataaaacgccgcgtcgcagagcttcagagaaacatggatttggagaacgggccgctggtacaggcgggactgttccgctctgaagcagaagattacttgtttctgacggtccatcatctcgctgtcgacgggatatcatggcggattttattggaggacttggcttctgcttatgagcaggccgcctctggacaggaaatcaaactccctccgaaaaccatgtcattcaaaacatatacggagcagctggccgattatgccgaaagcaaacagcttcttcagcaggcggagtattggcgggagattgaacactatgaaacagaaagtcttccttacgagcaggcagatctatctcaaactcctgcaaaaaaacggaacacggtatccttcactctgacagaaagtgaaacggacgccctgttgaaagatgtgcacagcgcctacaatacggatacgcaagatgtgctgttggcttccgccgtgcttgcccttcaaaagtggtcgccgcagcacgctttgaaaatcgcccttgaaggacacggacgccaatcggagcaggcaggtgcggacatcagcaggacagtggggtggttcacttccatttacccggtgcttgtccggagcggagtttatgaacctcttgaagaatatgaaattcgcacattgaaaaccgttaaagacacattgcggcgcattccggataaagggaacggatacggcgtcctcaaatatttaacaccgccgaagcttgccgggatgactttcgggaaagcaccggagatcagctttaattatctcggacaattcgatgcgcccggcgggagtccggcagaaacggaacagcctgacgcgtttcagttttctcctttgggaggcggagatgatgtcacagatacatggaaacgggagcagtcacttgaaatcagcgctattgcggcaaaaggccggatgaccgtcagcatttcctatgaaacggagcgcttccggcaagatacgatcgaacggctgtccgaaagctgccggtattatctcctgaaactgtcggaacactgcctcagcaaaaccgatacggagaagaccgtcagtgactttgatgatcgggagctgactgaggaagccttgcaggatattgccgacttactcagcttccactaaaccgagcgggaggaacacatggacaaaacaaaaaacatccaaaatatttatcccctcagccgaatgcaggaaggaatgctttttcattcctttctgcaaaaggagggggctgcatatatcgagcaatccgtcttcaccataaaaggccggcttcgtccggaattgtttgagcaaagcgtacagtctgtcatcagccgtcacgatattttcagaacggtttttttacctcatgtcgctcagctgaacggcccccgccaagtcgtgctgcgtgagcgggaattccggctgcaccgcgaagatcttacacatttggatgaagcggaacagagcgcctacttacagcgatttaaggaacgtgaccgcttaaaaggctttgacttgcaaaaggatatgctgatgcgtgtgtctttgtttaaaacggctgaggaaaaatatgtatgcgtctggagccaccatcacatccttatggacggctggtgcctcggcatcgtccttcaggaattcatgcatatgtaccgggcgattgaatcaggctcacccgtcacactggcgcccgcaaagccttacagcacgtatattacatggctgactgatcaggacaaagacgcggcttctgagtattggaaaggatatttagcaagctgcgagacaccctcaggactcccgaaaatatcggcccgtccccagggaaaaggctaccgtaagaaagagctcctgttttctttagatcaaaatctgacagacaggctgaaaaccatcgccaaagaagagggcgctacgctcgcggttcttatgcagactgtatggggcctgatgctgcagcgctacaaccggacggacgatgccgtattcggcgccgtcgtatcagggcggccttccgtcattgacggcgtggaaagcatgatcgggctgtttatcaatactgtgccggtacgcattaaaacgggtgacgaaagctttagagaactgctgggccgctgccagaaagaaatgcttgattcagaggcgttcagttatcatccgcttgctgacatccaatctcagactgagctgaaacaggatttaatcgaccatatcatcgtgtttgaaaattatccgattcagcagcagatgagagacgcggaaaaggaatcggatgcaccgttccggatcgggaatgtcaatgtttcggaacaatcgggctacgattttaacctcatcatagcgcccggcgatgagctgatcatcaaattcagctacaatgcgaacgtttatgacgaagtatggatagagagcgtaaaaggacacttggaagaagcgctgcgcggcgccgccttcaatcccgatgttcccgctgatcggcttccgatgctcggacaaaaggaaaaatcaagaataatcggcgaatttaatgacacgaaaacaacgtatgaaagagacgaaagcatcatcagcctgttcagccgacaggtgaagaaaaccccggaccatcaggcgcttcacgccggcgggctgacgatgacgtaccgggagctcgatgaacggtcaactgcgttcgcccgcatcctgctggaaaacggtttggcgccaaaaggaattgccgggattcttgccgaacgctcaccggaatttatcatcgctgttctcgctgtattgaaagcgggagggacgtaccttccgctcgatgcagaactgccatccgacaggatcgccgaaatgctcactgagagcggagcacagctgttaacggtacaaaaagggattgagactgacattgacttttctcacatcatctctatcccggctgcagctgaaaaacaaacagctgatgagggaaaactgaataccgttacgtcacctgatgaccttgcctatattatgtatacatccggttcaacaggaaaaccgaagggtgtgatgatttccaaccgcaacgtcgtatcgctcgtgtcaaacagcaattacacgtcagccggcacgacggaccgtctcattctgacaggatccatcggttttgacgcagtgacgtttgaaatcttcggagcgctattgaacggagcgtgcctccatgtggttgaccgcacgacaatgcttgcccctgagaggttcggcaattatctttcttccaacggtattacgattctgtttttgacgacggcgctttttaaccagtttgcccaggcggatccggagatgttttgcggattgcacaccttatatgtcggcggagaagcattgtccccggcgctcatcaataaggtcagacaccgctgtccgaatctcagcctttataacatatacggaccgacggaaaatacgacattttctaccttttacgaaatcaggcacgatttttctcagccgatcccaatcggaaaaccgatcagcaattcaaccgcgtatatcattgataaaaatggcggacttgcgccgatcggcgtgcctggtgagctttgtgtcggcggggacggggttgccaaaggctatttaaacaggcctgacttaacaagtgaagcatttgtcagccacccggttcatcctgaagaaaagatctacagaacaggggatttggcacactggctgcctgatggaagcatcggatacatcagccgtatcgaccgtcaattcaagattcgcgggaagcgtatcgagccggccgaaatcgaagcgcggctgactgaaattgatggaatcagggaagcggcagtcatcgtgtcagacgaaggacaagaagcaaccctttgtgcgtattatacaggcgcacatgctgaagaaagagccattcgatccctattggccaggtcgcttcccgactatatgattccgcagtatgtgatgaagcttgaccgtatgccgcttaccgcaaacggcaaagtggaccgccgcgggctgcctgcgccggaacggaaaaaagcttcatcaaaagccgttccgccacgaaactgggtagagcgtgagctgatcgacatttggacgccgatcctcggctgcggggagctgggcatacaggatgacttctttgagctgggcggccattctttgaaagcattgcaagtgattcatcagctgaagaccaggcagcagatggacgtcccgattgaaatgatatttgaatatccgacaattgaacaattggctgaaaagctgtattcaaacacactgtcagaagctgccgaacagcatatcagcagactgaatcagccgaaaggccgcaatcttttctgttttccgcctatctcaggtttcggcattttctttaaagatctggcggcggcattaaatggacgggctgctgtgtacggttttaactttattgaagaagacagcagaatggaacaatacattgataaaatgctggaaatccagccggaaggcccttatatcctcttcggatattcagcgggcggcaatacggcattcgaggctgcaaaagcgatggaaaagcgcggcttagaaatcagcgacgtcattatcgcagacgcgtacagaaagcttgacgcactgccgccgcagccaacaaacgcaacagccgaaaatgtcccggaagccgtcagggaagcggtcatcagaaaaacagagcgctatcaaacgtactgggcggaactgataaatgacggccaaattgcggcaaatctccattttattgaggccggcataaaggaagagcacagtgataagaccgagccgatgaaatgggaaggcgccacaacgggagtctaccaggaatatcagggcgagggagcccataaagatatgtttgagcccgagtttgcacacaaaaatgccgaggtcatactggacatcatcgcaaacagcggaagacgcttggcgcggaatctgtaacatccggcagaatgactgaagaagacaaagggcaagataggggaatcacactcagtttttttggaggctttgagatgacgaacctatcttggcttacgtatgtaatgattattcttgccagctaccggctgacccatttgatcgtatttgataagattacggaattcataagaaaaccctttataaagcaagaaaaaaccgtcgatcaaaacgggcgcgccgtccaaaaaaaagtcccttcctccgcattcggttatatgctgcaatgttattggtgtgcgggcgtctggtgcgccatattgatcggcatctgctatttggtctggccccgctatgcacatccggttattttcattttgtccattgccggagcgcaggccattcttgaaacatgcgtcggcgtcggaacgaaggtcattgacgtgctcgccgccataaaacataaaaagtcctgaagcgttttgattcgctttaggacttttttctttcccttttaggctgagaggagcaaagcaggctttctgattcaccgcccggaatgcttcggaataccgtaaagcagagagggggaaaaacatgaaaagctgccgttttagcatgatatggtttttggccgttgtactgacagccggcatctttacgttctcagcatccgcacaagcaagcggcactcagccggagagagaaatgcgagccgtatggatcgcgtctgtcaccaatatcgactggccctctaaaaaagggctgtcaccggaagagcaaaaaagagaatacagcaagctgctggatgacgttcagaagatgggaatgaacgccgttatcgtccaaattaagcctgcggctgatgctttttatccatcagattacgggccttggtcagagtatctgacaggaacccaaggcaaaaatcccggctacgatccgcttgcttttttagttgaagagacacataaacggaatcttgaatttcacgcttggttcaatccttaccggatcacgatgaatcacacaaatttgaatgcgctttcagatgatcatcccgcgcgttcccatccggactgggtcgctgcatacggaaaacagctgtactataatccgggcattccggaagtaagacaatttataacggatggaatcaaagaagtggtcagccgttatgacattgatgcggttcatatggatgattatttttatccttataaaattgccggacaggaattccccgatcaggcggaatacgaacggtacggaaaagctcactttgcatcgattgatgactggcgcagggataacgtcaaccggcttgtaaaagaaatcaacgaaaccatcaaacgagaaaaaccttatgtcaaattcggaatcagcccgttcggcgtatggagaaatgccgcagatgatccgacaggctccgaaacggccgccggggtgcggaactacgatgacttatatgctgatacaagagaatggatccaaaaaggatacattgattacatcgcaccgcaaatttactggagtatcggatttaaagcggcggcatatgacgtcttagcggattggtggggaaaagaagtgaacaatcggccggtgcatttatatatcgggcaggcagcttataaaatcaacaacaatactgatccggcctgggccgacccgggggaatacggaagacagattacgctaaacagaggatcagcatggataaaaggcagcatgcatttcagtttaaaggatttaaaccgtaatccgctcgatgtgaaaaaccgtttgatcaatgacatgtacagccggcccgcattaattcccgagatgccttggctcggacattccgctttaaaaaaaccggctgtcaaacgggcggagaagaacgcttcaggccatacactctatatcgaagatgcgaaatccaacggtaaaaaaacggcttattacgccatttaccgcgcagaaaagggaaagcagccttatttagtggatacagtcagaaaaacatcgtcacggacgcagacattttcagatactgttattcgggcggaagaagcatgcacctatatcgttacttccgttgacaggcttcaccatgagagccgtccctccgcaaaacggacgattaaatagccattattaataaaactgacagttgcggcactgtcagtttttttttgcggcggatgagtccgaatgttcagactttatttggatggaatgaataaagacccccattaataaaatgtagaaagcagcagaaggaggaaggttaatgaattttcaactgacaaaagaacagcagatggtgcgcgaaatggtcagagatttcgccaaaaatgaaattgccccgaaagcccatgaggttgatcaatcagccgtcttcccgatagacacatttaaaaaaataggcgaactcgggctgctcggaattccgtttccggaagaatacggcggggcgggcggtgacaccatttcatatgcagcagcggtcgaagaaatcggaaaagcctgcggcagcacggggctgagctacgcggcagccgtgtcactcggcgcaagcccattatactatttcggtactgaacagcaaaagcaagaacatcttgttccgcttgcttcgggaaaagcgctcggatcattcgggctgacagagccgaatgccggttcagatgccggcggcacccagacaaaagccgagaaaaagggcgatgactatgtgataaacggagaaaaatgctggatcacaaacgcaaattacgcccgcacggtcattgtcaccgccgttacgggaaagaactccgccggaaaaccgatcatttcagctctcatcgtcccgacagacacaccgggatttacgatcacaaatccgtacgacaagatgggtgtgagaggatcggatacggccgagcttgtgctggaggatgtcagggtgcctgccgataacctgctcggtgatcctgaaaaaggttttaaacaatttttatatacattagacggcgggcggatctcgattgcggcactggctgtcggtatcgctcaaggcgcactggaggcgtcgctgtcatatgcgaaggaacgcaagcagttcggcagtccgatatcgtcatttcaagccattcaatttaagctggccgatatggcgatggaaattgaccttgccagacaaatggtgcttaaagcggcatggctgaaggatcaaaacctgccatttacgaaagaagcggcattcgccaagctttatgcttcagaaatggccgtcagaacctgccttcaggccatccaaattcatggcggttccggttatatgaaggaatgcggtgtcgaacgtatgcttcgtgacgcaaagctgatggagattggagaaggaacatcagaaattcaaagaatggtcatcgcaagacagcttttgaagtgaaatgaaaacgtttactaagacagggatggaagggggcaggtcatatggctgaacttatccatttaacagccggaaagctgcttgagcggaccgcggagctttttccggatcatgaagcggttgtttaccctgagcgcggccttcgttatacgtatgccgagtttgaccggttatgccggcaaaccgcaaaagggctgatgaaactgggaattgaaaaaggagatcatgtggccatatgggcatccaacataccggaatggctcgcggcgcaatttgcaacggcgaaaatcggcgctgttctggtcaccattaatacaaattttcaaatcgcagaactcgattacctgctggcgcattcagacgtctcggccctgataatcatggattcctaccggcagacatcttatgttgagatggtgaataagctgattccggagctgaaaacttgtgagcacggcaggctgcgttcgaaacgttacccctttttacggacggtgttatatatcggtgataaaagtccgcccgggatgcaccgctgggattctttgctgaaggaaggcgaagctgtaacggatgcagcgcttgacggaaggatggacagcctgaaaaaggatgattgcattcatatgcaatatacatcaggtacgaccggatttccgaaaggcgtcatgctctcacattttaatatcgtaaataacgcggccaatatcgcagaatgcatgaagcttacttcaagtgaccgtttatgtattcccgtgccgtttttccactgcttcgggtgtgtgcttggcgtgctggcatgtgtttccgcgggtgcggcgatgattccgatcgaacagttttctccaccggccgttctgaaaacggtggagcaagaagcctgcacggctctgcacggtgtaccgacgatgtttatcgccctcctaaatgacagccgcttttctgaatatgatctttcccacgtccgaaccgggattatggcaggctcgccatgcccggcggaagtcatgagagaagtgatcggcaaaatggggatgaccggcattaccattgcctacggacagaccgaagcatcacctgtcattacgcagacaagaacggatgattcatttgaaagaagagtggaaacagcggggcgcgcgcttccccatatcgaagtcagaatcgttcggcccggaacatcccaagaagccgaccggggcgaacaaggagagctctgcacccgcggatatcatgtcatgaaaggttactataaaaatcaagaagcgaccgaagaagcgatagacaaggacggctggctgcataccggtgatttggctgtcatggacgaggacgggtactgcaaaatcacgggccgtctgaaagacatgctgatcaggggcggcgaaaatatctatccgcgcgagattgaggaaatgttatatcggcatcccgcagtggcagacgttcaggtcgtcggcgtgcctgatccgaaatacggagaagaggccgcggcgtgggtcaggctcaaagacggacaaaccgcttccgcagaagacatcagaaccttttgcaaagaacatatcgcccgctataaagtcccaggtatgttttgtttacagatgaatatccaatgacagcctcaggaaaaattcagaaattcaagctgcgggaaaaaacgattgaagagctcaagttaacttaatgaaaaaggagtgcttcacatttgtttaaaaaagtcctgattgccaacagaggagaaatcgccttaagaattatccgcacctgcaaacgtctcggcatcccctcggcagctgtgtattcagaagccgacagggacgcgctgcatgtaaaagcggctgatgaggcctatccgatcggtaaatcgagagtaaatgaaagctatttacatatcgacagaatcatagaagccgccaaatccgccggagcggacgccattcatccgggctacgggctgctgtcagaaaacagcctgttcgccgaacgctgccggaaggaacaaatcacatttatcggcccgcccggtgatatcatcgccaagatgggcagcaagatagaagcccgaaaaacgatgcaaaaagcaaaggtcccgatcgttcccggtgtttcagagccattgcccgatgttcactccgccttagccgaagcccgtgccatcggctttccggttatgctgaaagcgtctgcagggggaggcggaatcggcatgcagatcgtacattcagaagaagagctggccaaagcgttcgaaggcaatcaaaagcgggccgcgtccttttttggagacggcgcaatgtatatggaaaaggtcattgaaaatgcccgtcatattgaaattcagattctcgcagattctttcggcaacaccgttcatctgtttgaacgtgactgttcagtacaaaggcgccaccaaaaagtgatagaagaagcgccgtcgccgtttgttgacgatgaattaagacaaagactcggtgaaaccgccgttaaagccgctaaatcgatcggctaccaaaatgcaggcacaatagaatttctcgtcgaccaaaagaaacaaatctattttttagagatgaacacaagactgcaggtggagcatccggtgacagaagaaattacaggactggatcttgtggaagaacagctgaaaatcgccgccgggcaggcgctgactttctcgcagaaagatatcaaccaccgcggtcatgcgatagaagtgcggatctatgcggaagatccggtcaccttttacccgtcacccggtaccatctcgtctttttccgttttaagacacccgtcagtgcgacacgaatgcgccgtcgaaaagggaagcgtcatttctccgttttacgatccgatgattgccaaaatgatcgtcacggcgaatacgagaaaacaagccattgaacaactgaaaaccgcccttggcgaatatcatgtagaagggattaaaaccaacattccgctgcttacaaaaattgcacattcagaagtgtttgaaaagggtgaggcaacaaccggttttttacaaacaatgaacgagggggcgtcaaaatgagcgtcataaaaattcagatggcgggaaacctgtggaaaattcatgtgaagcccggtgatgtcattgaagaaggacaggaagtggccatcttggaatctatgaaaatggaaattccgattatcgctgatgcagcgggtacggtgaaagaagtgaaaaaatcagaaggtgatttcactgatgaaggagaggtcctgattgaacttcaataaaacgggaggtgcagcatgaactgtccggaatatgtccgcatcaatgaagtaggaccgcgtgacggcttgcagaatgaatcggcgtgggtggatacagaagataagattgagtggatcaatatgctgtcaaaaacaggccttccctatatcgaagtgacatcattcgtgcatccgagatggattccggctcttcgtgacagcctggacgtcgcaaaaggcattgccaggtctgaacatacggtctacgcggcgctcgttccgaacctcatcggactggagcatgcggcagaaggcggaatcgatcaggcctgtgtatttttatctgcaagcgaaacccataaccaaaaaaacgtaaacaaaccgattgaccggaccgttcaagagctcaggcgggttattactgaagcaaaagctgaaaaaatggcgacgagagcttatctgtccactgtgttcggctgtccgtacgaacagaacgtgccggtcgaacaagtcatccgcctgtcagacacactgctcgaaatgggtgttgatgaaatatcgctcggcgacacgatcggcgcggcaaaccccttgcaggtcatatccgtgcttgaagcccttttgccgagaattcccgcctcaaaaatcgcactccatttccatgatacaagaggaacggctctagcgaatatcattcccgctcttgatatggggattacatccttcgatacttcctcaggcgggcttggcggctgcccgtacgcccctggatcagcaggcaacgctgccacagaagacgtcatttatatgctcgaacaaatggggattgataccgggacggacatgaataaacttcttgatgccgcccgctggatcgcggataaaataggcaaagatctgccaagcagaaatctgcaggcattcagaacgaaatgagaaaggagaagccatgggagattgcgtcttgtattccgtctgtcaagaaacgatcggtctgatcacgctgaaccgcccgcatgcggccaactcgctgtcttcagaaatgattgatcatttacagcgtgtgattgaagacatcaaaaactcgccatccattcgctgtgttattctcaccggctccggaaacacattttgcgccggcgctgatttaaaagaaagagctgggatgaatcatgaacaagttaagcaaagcgtcaggcgtatcggtgaaacggctgcatccattgaagctctcccgcagccggtcattgcagcgctgaacggaaccgctgtcggaggaggccttgaactcgctctcgcctgcgatatcagaacagccgtcagccgggcgggcctcggccttcctgaaacagggcttgcaatcattcccggggcgggcggaacgcagagactgccccggcttatcggccccggcgcggcaaaagaattgatctataccggccgaaggctttctgccgaagagggaaaagacatgaagctgatcgagcatgtttgtgaagccgatgaacttatggaaaaagcaaaagcactggccggccgcatcgccgctaatgggccgatcgccgtcagacaagcaaaatccgcgataaacaagggtctggagacagatctcaatacagggctcgaaatcgaacgaaaagcatatgaacaagtcatccctacacttgacagagaagagggcctgcgcgcttttaaagaaaaaagacccctgaatacaaaggaaaataaaacatggagggactcggatggattacgaaaaagaacggcagacacgcagcaaaacgattgaaaagggaggagccgcgaaatatcatgcaagcaacgaaaagaagggaaaactttttgtaagagacaggctgaagcttttattcgatgacggcatatccgttgaagacgcttttttcgccgagtgcatgtcagacggactgccggctgacggggtcgttaccgggatcggaaccatcggcggcagaaccgtttgtgtgatggcaaacgactcaaccgtaaaggcgggctcgtggggcgcgaaaacggtggaaaaaatcatccgcattcaggagacggcggagaagcttcagtgtccgctcttgtacttagtcgattccgcaggtgcgagaattacggatcaggtcgacatgttcccgggcagaaggggagccggccgcatcttttataatcaagtaaagctgtcgggccgcattccgcaaatctgtttattgttcggtccttccgctgcgggcggcgcttacattccggccttttgcgacattgtcattatggtcgaaggcaatgcatccatgtacttaggttccccgcgcatggcagaaatggtgatcggcgagaaagtatcgcttgaagaaatgggcggcgcccgtatgcattgttctgtatcaggctgcggtgatctcctcgccccgacggaacaggaagcaatcatgatggcgcagacatatctcagctactttccggcaaattatactgaaaaagcgcccgtcaacaaatctaagaacccgaaagcttttgaaaaaccgctctcagatgtcatcccggcacatcaaaacgcaccgttcaacatgatggatttaattgaacgtgtcattgatgaagactcgttttttgagattaaaccgttatttgcgcaggaattaataacggggctcgcgcggattcacggacagccggtcggcattatcgccaatcagccgcgtgtcaaaggcggagttttatttctcgattcggcggataaagccgcaaaatttatcgctttgtgcgacgcattccatattccgcttctgtttttagcagacattcccggattcatgatcggaacgaaggtggagcaggcgggcatcatcaggcatggcgcaaaaatgatctccgcaatggcggaagcgactgttccgaagctttccgttatcgtcagaaaagcctacggtgccggattatacgcgatggcggggcctgcttttgaaccggactgctgtttagcgcttccgactgcgcaaattgccgtaatgggtcctgaagcagcggtgaatgcggtctacgcaaacaaaatcagcgagctggcccctgaagaaaggccggcttttattcaagaaaagcgtgatgaatataaggaagacattaacctttaccggcttgcctctgaaatggtgattgacggcattgttcctgctgattccttgcgggaagaactcaataaacgcctcactgcttacatgtccaaacaactgacattcacacaccggaaacaccccgtatacccggtataaataaaaaaagactgcatagatccggctcgcagccgttcttatgcagtcttttttcacagtcttgatctcattttcttcacaacaaaataaacaacaataaatacgagagccaatataatgatcggagttgtatacattccggcatagctgtctacgtctttccactgtcccccgagctgatacccgagataaacgaaaatgacagaccacggaataatggcaagcgtcgtcaatatgacaaacttggaaagaggcattttcgcaaggccggccgggatggaaatcgcatgtctgacgaccgggataaaccgcgccgagaacacaacgccggcgccgtaacggcgaaaccagttttccgcaacatcaacatgatgctttttcagaagtaagtacttgccgtacttgtccaaaaacggccgtcccccataacgggcgatccagtatataaagcactgcgcgatcgttcccccgatcacaccggcgacaatggcgccgataaagctgatcgtgccttctgacaccatatagcctccgtaagccagaacgatttcactcggaatgatttcgatcattaatccgagcgcaatccctaaatagcccatacttgtcagccaggataatatttcactaataaaattgcccacactgttcacaacctctttatctttttacccaattatatgactgattgacaagcaaaatggttacaaattattttttaacgcacgatttcttcagattctctttttaacacctcttctaaataagctaaaagtttcggtctcatttcttcccgcagaagcccgatctccgtgccggccttaaaacagccgaacttatctcctatatcaaaccggcttccttcaagctcccgcgcgtaaatgcttcgggtgcggcatacttcgcgcagcgcgtctgtcaattggatttcgctgcccgcgcctcttccgatcgtcttcagcgctttaaaaatggcaggggttaatatgtaacggcccaacacggcaatatgagagggcgccttttcaacggccggtttctcaatcagatcctcaacccggtacacatgaccgctctgccgccccgtctgtataataccatatttgctgacatcagcaggatcgacgggctgtacgccgatcgtttctgtgccgtgttggttatagacgtctatgagctgtgaaagagcgggagtgtcagataccataatatcatcacctaatagaacggcaaaaggctcatctccgataaaatgctccgcacacagcaccgcatggcctagtccgagcggttctttctgacggatgtaatgaatattggccaaatcggcaatccgctgcatttccttcagtgtctctgacttgcctttttccttaagattgatttccaactccgccgaccggtcaaaatgatcttcaatcgagcgtttgtttctccctgtaataatcagtatatcttcaattcctgactctcttgcttcttcgacaatgtactggatggccggtttgtcgacgatcggcagcatttctttcggctgcgcctttgtcgccggcagaaatctcgttcctaaacccgctgcggggatgaccgcttttctcactttttttctcattcatcttcactcctgatcctgtatgtttttcagcgaatctccaaatacccagattcggtttccgataaaattcatcatcattccgccgatagtggcggcgagcttactcaccaaaagcgaacagccgcctttttgaaacgcgtacagcagcaaaaaggtgattcccgacgctgcaagattaatgatgagaaagcgcacgatctctttcccgtcagccttgtgttttacacgaaacgtccacttccggttccacacatagctgttgatgatccctgccgaataggagcagatctgcgccggcagataggggacaaggcaagcggtgagaagaaagaagacaccaaaatcgatcagcgtattgccggcgcccacggtgcaaaaacggcctgctgtctttactttttctttcagcataacggcatccggttttgacctcccttcataagtaagatgcggatcgctgtcctatttgttgatatggattactttagcggacagtgttgaataaacaattactaaaatatgaacaaaacatgaaaacgtaatgaggctttgtaaaacccattaagttaacagttttatattttaggttgacatattacgtgcaagacactaatattctgtattagtgttaaccttttattattttggttaacattaaatttcgaaataaaagaaaggagggaaatttcatgcaggaagagacctattacagcgtcagaatgagagcttcccgaaacgcccccatgagcagggcggaaaacatatttccggcggagaacggctcatcacttacagcggtttacaggaagcggtagatggcttattacataaaggcttctcacactcaagagggatacctgattttatgcagattcagcttgaaagcgttcatgaaccgatcgaaacgatccgccctttgccggttgccctccatcaaacagacacgccggaaaaaggacaagcaatcgcccgcaagcttctgcaaaaggcggggattcctccgcacatgatcgagaaagcgtacgaaaacatttcggaatatgcagaagcaagaggagcggtcctgtttgatatccgggcaggaaaacgcattgactgcagagggaatagaggtgtgcgggtatcccgagtggattggccgtcacctgattttcaaaaatgggcttttactcacaacatgccggaaaattcacgaataaaagaagcacatgccatcgcggcaaaagtttgcgcacatccgggaattattgccgaattgtgctggtcagatgaccctgattacataacaggttacgttgctgcaaagaagctgggatatcagcggattgccaagatgaagaatgccggagatgaaagcggatgccgggttttctttactgatggctccatagatacggagagctgtatccattttttagagaagcagcctgtattcattcagcgggaggagaacatatgaaacaatcaatgattgaaaaaagcaaacagcatctttggctgcctttcacacaaatgaaagattacgatgaagatccgttcatcattgaaagcggaaacgggatcatgctgaaagacatcagcggaaaagaatattatgacggcttttcttcagtatggctcaatgtacacggccaccgcaaaaaagaaatggatgaagcgattcaaaaacagcttgaaaaaatcgctcattcgactttgctgggtatgacgaacgttcccgcaacagaacttgccgagatgctgacgggcatcacaccggaaaagctgacgcgcgttttttattccgacagcggagcggaagcaatggaaatcgctctgaaaatggcctttcaatactggaaaaacgtagggagacctaagaagcagacgtttatttcgatgcagaacggctatcacggcgatacaatcggagccgtcagcgtcggctccattgaactcttccaccatgtgtacggcccgctgatgtttgaaagctacaaagccccgattccttatgtatacagatctgaaagcggtgaccccgtacagtgccgggatgaatgccttcacgcgctcgaacagctgcttgcaaagcaccacgaagagattgccgcacttacgattgaatcgatggtgcaaggcgcatccgggatgatcgtcatgcctgaaggctttctggcaggcgtacgaaagctgtgtacggcatatgatgtgttaatgatcgttgacgaagtggcgacggggttcggccgcaccggaaaaatgtttgcctgtgagcatgaaaacgtccagccggacttgatggcggcagggaaaggcattacgggaggctatttgccgatcgctgtgacgtttgccacagaagccatttatgaagccttctacgatgactacgacaaaatgaaaacatttttccacggccattcctatacaggaaatcagcttggctgtgccgcggcaattgaaaatctgcgtttattcgaatcagagcgcatcgttgaacgagtcgccgaaaaatcaaaaacggctgcggaatttcttcatgatctgaagctgcttcctcatgtcggcgatgtccgccagctcggtttgatgtgcggcatagagcttgtgcaggataaggggacaaaacagccttatccgcctgaaaagcggatgggatacaaggtgtccttgaaaatgagagagctgggtatgctgacacggccgctcggtgacgtcatcgcctttcttccgccgctcgccagcacaaccgaccaattacaagccatgatctccattatgaaagaagcgatagccgaggtgaccggccgtggattttgacggatggctcctcggaaggctcgatgcggtgaaaagagacgggctgtatcggacgctgcgaacacaggaaaccgctcttaaaaccaaggggcaaaagcggcagacctgggcgtccaatgactatttaggtctgtcaaaagatgaacggctgatcacagccgcgcaaacagcgctgagccggttcggagcgggaagcggcggctcacggttaacgacaggaaatactgtgtggcacgaaaaacttgagcaaaaaatctccgactttaaacagacggaagcggctttattattttcaagcggttacttggcgaatatcggcgtgcttgcctcactgcctcaaaaaggcgatgtcattttaagcgatcaactgaaccatgcgagcattgttgacggctgccgtttatcaaaagcggaaaccatcgtgtaccgccatattgatatggctgatcttgagaaaaaacttgcctccgtccagactcggaaccgccgctttatcgtcacagacggcgttttcagcatggacggcaccatcgcgcctcttgaccgaataatgccgcttgcaaagcagtaccaggcatttgtgatagcagatgacgcgcatgcaaccggtatactcggggaaaacggcggaggaaccagtgactatttcggtgtttgtcctgatgttgtcatcggcacattaagcaaagctgtaggaacggaaggcggttttgccgcgggatcaaacatttttattgattttttgctgaatcaggcgcggacgtttatttttcagacggccctcccgccgtcaatttgtgcggcttcgcatacggcatttgacctcatatcagatatgcacgatacgcgccgtgagctgcagtcgtctgtcaaaaagataaaaacgcgtctggccgatatgggctttactgtaagaggcggagatacaccgattatccccgttatcatcggtgatgcaaaaacagcggtttcagccgctgcgctgcttgagaaaaagggaatctgcgccccggccatccgcccgcccgccgttccggaaggcgaaagcagaatcaggctgaccgttacggcggatcgcagcttacaggacatagacgagctgacggaagcatttgattccattagaaaagagctgaatataaacaaatgagaagtttttttgtcacaggaacagataccggcgtcggaaaaaccatcgtttcttgcggacttgccgcggcattcaggcagaaacaggcggatatcggagtgtttaaaccgtttttaagcggcgtgccgcggactcatccggaaagtgacacctcgctgttgaaaaacatgtcacaaaccgcactgtctcatgaagaaatcacgccatttgaatggaaagagccgcttgcgccgtacacggccgccatgcttgaggggaaatccgtgagcatggatgaagtcatggcccactggagtaagatcaaaaatcgtcatgagtgtttcatcgtcgaggggcaggcggcatttccgttccgcttggtgaaaattacttagtcagtgatttgataaaagccttggaattaccggcagtgattgtcgccaggcctgatctcggaaccatcaaccacacatatttaaccgttgaatatgcgaaaaacatgggaatagaggttctcggtattattatcaacggcgtaaagagccggccggggctggacgagaagacaaacccgagcatgattgaaacattatgcaaagttccgattttgggaatcacaccgaagctggatcacgtttcaccggaaaacattcaacacatgattgagaaacatatagatgtttcctctttcatgaatctgacacaaatggggagataaacatgaatcaatggatggatcttgcagagagagttctggacggggcggaagtaacgaatcaagaagcgctggccattttaaattgtcctgatgaggatcttttattgctgatgcatgccgcttttcatatcagaaaacgattttacggaaaaaaagtaaagctgaatatgattatgaatgcaaaatcaggcctgtgtccggaaaattgcgggtactgttcacaatcttcaatatcaaaagcgccgatcgagtcttatcggatggtggataagcatatattgcttaagggggcaaaacgcgcccatgacttgaatatagggacatactgcatcgtcgccagcgggcggggaccgtcaaacagagaagtagatcaagttgttgatgctgtcaaagaaattaaagaaacttacggtttaaaaatctgcgcatgcctcggtctgctgaagccggaacaggcagagcgcctgaaacaggcaggagtagaccggtacaatcataacatcaatacatcacaaaggaatcactcaaacattacgacttcccacacgtatgacgacagggtcaatacagtggaaacggcgaaacaatcggggatgtcgccttgttcgggtgtcatcgtcggcatgaaagaaacgaaacaggacgtcattgatatggcgaacagcttaaaagcgcttgacgccgacagcatcccggttaattttctgcatgcgattgacggaactccgttagaaggggtaagcgaattacatccggtgtattgcctgaaagtgctcgccttgttccgttttatcaatccgacaaaagaaatccgtatctcaggaggccgggaagtcaaccttcgttcgctgcagccgctgggactttacgccgcaaattcgattttcgtcggagattacttaacgacagcagggcagcatgaaacagaggatcatcaaatgctccatgatttagggtttgaagtcgaatccgttgaagaaatgaaagccggcctgcaatccgcctgcaatacggaggtataagatgacggcgggcctatcgactgcacatccgtccctccatgcggattcggatttttggaatgacccttacccgttttatgaaaaactgcgtgccattgatcctgtttataaaggaaccgtattaaaacatccgggctggtatgtcaccgggtataaagaagcggcagcgattttgaaagacacccggtttaaaaaccgcgtcccttttccggaagcttcaacgaaatatcaaaatctatctcatatccagcacgatatgctgttatttaaaaatcaatcagaccataagcggatgcggatgcttataggtaaagaatttaccgcaaagacggcggaatcacttcgcccctgtataaaagaaacggttcatgacttgttggatcaaatccaaaacaaaaaaaacgcagaccttgtttcagagtttgcctttccattggcaagcctcatcattgcggagatactcggagtgccgaaagaggagagatatcaattcagacaatggacggcagacgtcattcaggccattgatcttacccggtcaagaaagatgttagtcagagcaagcgacaccgcaggcaggctgactgcatatttcagagatttgattcacgagcggaaagcacatcctcaggaagacttaatcagcaggtttattatgggggaacagctttcaaaagacgaagtgctcgcgacatgtatcttacttgtcatagccggacacgagacgacggtaaacctcatgagcaacggtgtgtttactttattgaaacaccctgaacagcttagcgcactgagagaaaacccctcgcttattgaaactgctgtcgaggaatgtctgcgctacgacagccccgcgcagctgacggcacgcaccgcttcagaagactgtgaaataaatgggaagaccataaaaaaaggagagcaggtatatatccttttaggggcagccaatcgcgatccaagcatattcgatcagcctcataaaatggacatccaaagaaaaccgaatccgcatcttgcattcggaaagaacgcccatttttgcataggctcctcattagcgcgcatcgaagcacaaattgcaattctcacactgtttgagcggatgcctaagcttcggctggccgcacaccgccttgaataccgcaagctcattggttttaggtcgctcaaagagcttccggttgtccttggctgaatgaccatgcaggagggccggattttatcggttcctcttgcaggaaataaatgaaagaaaaaagaatacatatttataaagcaaaaatcctctctgatccatctcactatccctaaaaaaactcgctgctcagccattcaatatcatacagcaagaatctccttttctttcgccaaaacggaaaattcaccatgatgcacattttttcagcctcagaaacggtgcaaaatcggcatgttttctgctttattttcttgatctttgtaagcgcttactaatattgagcagaaaagagggggatttgtggacattgttattattttattggcattaggcatgctgatgtttgcggcttaccggggcttttcagtcattttattcgccccgatttgtgcgctgtttgccgtgctcctgacagatccaagcttcgtacttcctttcttctcgaatatatttatggagaagatggtaggatttattaagctgtattttcccgtatttcttttaggggccgtttttggcaaggttgttgaaatatccgggctcgccgagtcgattgcaaaaacaatcgtcaggcttgtgggagcaaaaagagccattctcgccatcgtcttaatgggtgcgattttaacgtacagcggcgtcagtctcttcgtagcggtgtttgccatttatccgtttgctaaaaacctatttattaaagctgatattcccaagcgtctgatacccggtacgattgcattgggcgcgtttacttttacaatggatgcgcttcccggcacaccgcaaattcaaaatgtcattccgacagctttttttaaaacaaacatttatgccgctccctggctcggactgattggcgcagcatttgtgcttacggccggaatgatttatttagaatcccggcgcaaaaaagcggccaatgccggagaaggctatgctggatttcaatctgaagtttccgctgcagaggattcctcaagtctggctaatgaaaaacatacgcctgttttaccgcaggaggcagaacccagccccgcgcggcaagtgctcgcctttgttccgcttatccttgtggggatcatgaacaaatgcttcacgatgtggctcccgcattggtaccctgacggatttgattttgcgcagctcggtttaaaagcgttcgggaagattgacctttcctccgtcactgcgatctggtcagtagaactcgcactgctcatcggaatcatgacaacgattttgttcgattggaaaaaagtgctcttcaatttgaaagaaggactgaatgagggcatcgggggtgccttgctggcgtcgatgaatacaggagccgaatacggatttggcggcatcattgcggcgcttcccggctttaaaatggtcagcagcggcatatcgcagacgtttactgatccgctcgtcaacggagcggtgacgaccactgcgcttgccgggattacaggatcggcatcaggaggaatgggcatcgctttaagcacgatgtcagcagcatatacagaagcaatcaatacattccacattccgccggaggtcatgcaccgggtgatttcgatggcctccggcggaatggacactcttccgcataatggcgccgtcattacgctgctcgcggtcaccgggttgacccaccgccaatcctacagggatatctttgccattaccgtcattaaaacagcagctgtgtttgtcatcatcgccatttacagtctgacgggccttgtgtagccaaaacagaaaggggaaacgaatatgggaaaaggaaaagtgatggactcttataaagatgctgctgcactgatcaaggatggagacaccctcatcgcaggaggcttcggcctgtgcggcattccggaacaattaattctcgcgatcagggacagcggcgtgaaaaacttgaccgttgtcagtaataactgcggtgttgatgattgggggttaggcctcttgcttgcaaaccggcagatcaaaaaaatggtcgcatcctatgtcggagaaaacaaaacctttgaacggcagtttttaagcggggagctggaagtcgaattggtgccccaaggaacgctcgcagaaagaattcgcgcgggaggggcgggcattccggcgttttatacacctgcgggcgtcggaacatcagtagccgagggaaaagaacataagacatttgacgggcgcacctatcttctggagaaagggattacagggaacgccgccatcataaaggcctggaaagccgatcctctgggcaacctgatgttcagaaagacggcgagaaatttcaatccgctcgctgcaatggcaggcaaagtgacgattgcagaggctgaagaaatcgtcgatgccggagagcttgatccggatcaaattcatacgccgggtatttttgtgcagcatgtgctgcttggcgggattcatgaaaaacggattgaacgccgcaccgtccggcaagcatgataaaggaggctgacagaatgagagatagcagaaaacgaatgatcaaacgggctgtaaaggaaataaaggacggaatgaatgtgaacttggggatagggatgccgacgcttgtagccaatgagataccgaatgattataacgtcctgcttcagtctgaaaacggcttgctcgggatcgggccttatccggcggaaggaacggaggaccccgatctgatcaatgcgggaaaagaaaccattaccgaggtaaagggagcctcgtattttgacagtgccgaatcctttgccatgattcgcggcggccacattgatgtagcgattctcggcgggatggaagtgtccgaacggggagatttggcgaactggatgatccccggaaaaatgatcaaaggaatgggcggcgccatggacctggtgcacggagcaaaacggattattgtcattatggagcatgttaataaatatggggaatctaaagtgagaacggaatgtacgctgcctttaaccggcaggcaggtggtcgatcggctgatcacagatttggctgtattcgattttcatgatggccgtatgacgctcaccgaactgcaggaaggtgtaacaatggaggaggtctttgagaaaacagaaggtcattttactgtcagccagtcgttaaaaaacggggtcagaccaaaatgaggaggtgccgccatggattcattgcttattgaaaaaacagccgttgtaacaggagcagccggaggaatcgggcttgaaattgcaagagaattcgcccgtgaaggagcagccgtcatcatctctgatgtaaacgaacaagcggggaaagaagcggcggcaggacttaaagatgaaggctgtgaagcagtcagcatcacatgcgatgtaacaaatgaaaagcaagtggccgacatgctgcagacggtcgagaaacaattcggacgtctcgatatccttgtgaataatgcgggcattcagcatgtcgcgcccatcgaggaatttcccaccgaacagtttgaacggctcattcgtgtcatgctgactgcgccatttatcgcaatgaagcatgcattccccattatgaaaaaacagcaattcggtcgaatcattaatatggcgtctgtcaacgggctgatcggttttcacgggaaagcggcatataacagcgccaagcacggcgtcatcggtttaacgaaagtcggtgcacttgaaggcgcggctgacggcattaccgtcaatgcgctttgtccgggatatgtggacactcagcttgtccgcaatcagttaaaggacatttccgcaacaaggaatgtaccgtacgagcgggtgcttgaggacgtcatctttccgctcgttccccaaaaacggctgctgtcagtgaaggaaatcgctgattacgctgtatttttggccagcgacaaagcaaaaggggttacaggtcaggccgtagtcatggatggcgggtataccgctcaatagttcttatatttttttaaaaacagccgctctgaacggctgtttttttatgcctgaaaaacttgttcactcaataggccgatttactgcccaaccggtatccgggctgggtcattcacatgttctgcggcgtattttgtccttgcagatttttctcatccagatccatttctgcgccgcatttataatcaagcgccatcagtttacaatccttcacagatatacaaatgaatttttacaataaacataaaatatgtaatttctgacacaataatgccaatagccctaaaacatatgaaacatgaagagcgcgacctaagtgatgaagagccggtaacaggctccactccggcttttcatcatctctctttaagactgattttcggtgaaaccccatgttttattttatgaataaatatatctaattcgtttgtaaaatcgaacaataactcctccgaaagtattctatacacatttgttataatcatgctaggatgttagataaagggataatttgtaggatattgtatttctgttcaatatgatcggaggaatctcatgaacaatcttgcctttttatttcctggacaagggtctcaatttgtaggaatgggcaaacaattttggaatgattttgtgctcgcaaagagattgtttgaagaagcgagcgatgcgatctccttggatgtaaaaaaactgtgttttaacggagatatgaatgaattgacaaagacaatgaacgcgcagcccgctattttaacggtcagtgttattgcttttcaagtgtatatgcaggaaataggggtgaagccccgcttcctggcaggtcatagcttaggcgaatattcagcgcttgtctgtgccggcgccctttcttttcaggatgccgttacacttgtaaggcagcggggaattcttatgcaaaatgcggatcctcagcagcaggggacgatggccgccgtgactcacctctctcttcaaacgttgcaggaaatatgttcgaaagtgtcgacggaagactttccggcaggagtagcctgcatgaattcagaacagcagcatgtgatttccggacaccggcaagctgtggaacgtgtcatcaagatggcggaggaaaagggagcggcatacacttatttgaatgtcagtgcgccttttcacagttcgctgatacgatcagcatctgaacaattccagactgtattacaccggtattccttccgggatgccgcatggccgatcatttcaaatgtcaccgcacgcccttacagcagcggaaattcgatcagcgaacatctcaagcagcacatgacgatgccggtaagatggacggaatcgatgcattacttgcttttacacggagtcacagaagtcatcgaaatgggtccgaacaatgttttagccggtctgctgagaaaaacaacgaatcacattgtaccttatcccttaggacagacatctgatgttcacttgctttccaattcagcggaaagaaagaaacatattgtccgtttacgcaaaaaacaactgaataaattgatgattcaatccgtcattgcgcgaaattacaacaaggattcagcggcttattccaatatgacgacggcattatttacgcaaatccaagagctgaaagagagaatggaaagacatgaaaatgagctctcagaacaagagctcaaccattcgatccatttatgcaaattaatttgtgaagctaaacagcttccggcttgggaagaattgcggattttaaaataaagcgcccaggaggggacctatgtataccagtcaattccaaaccttagtagaagtcattcgggaaagaagcaatatctctgatcgcgggatccgttttatcgaatccgataaaaacgagacggttgtctcttatcgccaattgtttgaagaggcgcaagggtatcttggctatttacagcatctcggcattaagccgaagcaggaaattgtatttcaaatccaagaaaacaaatcatttgtcgttgctttttgggcttgtatattaggaggaatgatcccggtgccggtcagtatcggagaagatgatgaccataagctgaaggtctggcgcatttggaatatattaaatcatccgtttctgattgcctctgaaaaagtattggacaaaataaagaaatacgctgcagaacacgatttacaggatttccatcatcaattaaacgaaaaatctgacatcattcaagatcaaacctacgattaccccgcttcgttttatgaacctgatgcggatgaactcgcctttatccaattttcttcaggatcgacaggagatccaaaaggagtcatgttaacgcatcacaacttaatacataacacgtgcgccattgggaatgccctagccgttcattcgaaagactctttcttatcatggatgcctttaacgcatgatatggggctcatcgcctgccaccttgttcccttcataaccggaatcaatcaaaatctaatgcctacagaattatttattcgcagacctattctttggatgaaaaaagctcatgaacataaagccagtattctatcctctcctaatttcgggtacaactacttccttaaatttctgaaaaacgaaccagactgggatttatcccacatcaaggtcatcgcaaacggtgcagaaccgatattgccggagctctgtgacgaatttttgaaaagatgcgcagcattcaatctgaaaagatccgccattttgaatgtttacggtttagcggaagcttcggtcggcgcagcattctctaaattaggtaaagaattcgttcccgtttatttgcatcgtgactatttaaatcttggtgaaagagctgtaaacgtcagcaaagaggatcaaaattgcgcttcattcgtcgaagtgggacgacctattgactattgtcagcttcggatctccgatgaagcaaatgaaagagtagaagacggaatcatcggccatatccagatcaaaggagacaatgtgactcaagggtattataacaaccccgagagtacggaaaaagcgctgacttctgacggctgggtaaaaacgggagacctcggattcattagtgaaagtggtaacttagtcgtaacgggaagagaaaaggacattattttcgtgaacggaaaaaatatctacccgcacgatattgaacgggtcgcgattgaaatggaagaggttgacttaggaagggttgccgcctgcggtgtatatgatcaaaagacacaaagcggagaaatcgtgctctttgttgtttacaaaaaatcacctgaaaaattcgcaccgcttgtcaaagagataaaaaagcatttgctcaagcggggcggctggagcataaaagatgtccttccgatccgaaaactccctaaaacaaccagcggaaaggttaaacgctacgaacttgccagacagtatgaggcagggaatttttcaacagagtctgccgccatcaatgaatatttggagagcagcccggaaacgtccggacagactcccattcatgaaattgaaacggaattactgtctatcttttccgatgtgctcaatgggaaaaaggttcacctcgctgacagttattttgatatgggagcaaattcattacagttatcgcagattgccgagcgcatagaacagaaattcggacgcgagcttgccgtttcagatctctttacgtatccttctatcactgatttagcggcatatctgtctgaaagccgggctgaaatcaagcaggacgtggcagcgaaaccaagccacgtgacgccgaaagatatcgccattatcgggatgtcgctcaatgtccctggagcatcaactaaaaatgatttttggaatctgcttgaaaaaggtgagcacagcattcgagaataccctgcatcccggctgaaagatgcggcggattatttaaagtccatccaaagcgaaatcaatgagaatcagtttgtgaagggcggctatttagatgaaatcgaccgctttgattactcgttcttcggtttagctcctaaaacggctcagtttatggaccctaaccaaagactgtttttgcagtctgcatggcatgcgattgaagatgcgggctatgccggcggcagcatgaacgggagccgtgtcggggtatatgcagggtactcgaaggtgggctacgattatgaacgtctcctttctgcgaattatccggaggagcttcatcaatatatcgtgggcaatctcccttccgtgttagccagccgaatcgcttatttcttaaatttaaaagggccggcggtgacagtcgatacggcgtgctcctcatcgcttgccgccgttcatatggcatgtaaatctttaatatccggcgattgtgaaatggctcttgccggcggtatccggacatcgctcttgccgatctgtatcggacttgatatggaatcttcggacgggtacacgaaaacgttcagcaaagattcagacggtactggcacaggtgaaggcgcggccgcagtcctgctgaaacctctgcaggatgctgttcgcgacggagaccatatttacggcgtaatcaagggaagcgcgttgaatcaagacggaacaaccgccgggattacagcaccgaatccggcagctcagactgaggtcattgagacggcctggaaagacgcgggcattgcccctgaaacactgtctttcatcgaagcgcatggcaccggaacgaagctcggcgatccggttgaatttaacgggctttgtaaagcgtttgaaaagtatacggcaaaaaaacaattttgtgcgattggttctgttaaatcgaacatcggtcatttgtttgaagcggcaggcatcgtcgggctgatcaaatctgtcctcatgctgaatcacaagaaaaatccgccgttagtgcactttaatgaacctaatccgctcattcattttcactcttcaccattttacgtaaaccaggaagctgcagcgttcccatccggtgatgagccgctgcgaggcggagtcagctcatttggctttagcggaacgaacgctcatgtggtattggaagaatatatttctcaaagtgagtatgcgcccgaggatgaacatgggccgcacctatttgttttatccgctcatactgaaaaatcactctatgaactcgcacagcagtaccggcaatatgtatcggatgacagccaagcttcattaaagtccatttgctatacagccagtacgggcaggactcatttggatcatggcattgccatgattgtatccggtaaacaagaactatcggataagctgacccgcctgattcagggagacagaaaccttcccggtgtatacatcggctacaagaatatgaaggaaatgctgcccgctcataaagaagagctgaataaacaagcagccgcactgattaagcagcgtttacgtacgcaagatgaacggatcacatggctgcatcgcgccgccgaattatttgtgcaaggagccgttatcgattggcgcgcgctttattcaggtgaaactgtacaaaagacgccattgcccgtgtatccgtttgaacggagccgatgctgggctgaagctgaccaattgcgcttaaacgaggacgaaaagagaggagaagcggcattgaatatcaatcaatcgaagtcgcacattgaatccttcctgaaaactgtaatcagcaatgcttcggggatcagagcggaggaactcgatctgaatgctcattttatcgggctcggaatggattctatcatgctgtcacaggtcaaaaaagccatcgcggacgaatttggggcagacatcccaatggatcgtttttttgatacgatgaacaaccttcaaagtgtcatagattacttggctgagaccgttccatcgtcctttgcatccgctccgcctcaagagaatgttccggcgcaggaaatacaggtcatttcagaagcacagtctgaatcggatcgcagagaaggtcaacaagagcatatgcttgaaaaaataatcgcttctcagaatcaattaattcaggataccttgcaagctcaattaaatagctttaatttgttgagaaacagcggacatcattccgatgagaaagaatacgctaaagcgcaagagaaatcaattccttctgtcaagcaggggcctccggccgtcactgcagaaaagaaagcggctcaagaagcgaaaccctatgttcctttccagcctcagaacctgcatgaacagggacactataccgcacggcaaaaacaatacttagaagatttcatcaagaaatacgcagataaaacgaaaggttccaaacaatatacggacaacacccgatttgctcatgcaaacaaccgcaacttgtccagcttccgttcgtattggaaggaaatcgtatacccgattatcgccgaacgttctgacggttctaaaatgtgggatattgacggaaatgaatatatcgatgtcaccatgggattcggggttaaccttttcgggcatcatccttcctttattacacaggttatcgatgattcagcccgttcatcattgcctccgctcggcccgatgtcagatgtcgccggtgaagttgccgaccggatccgcacatgtaccggagtggaaagggtcgctttctataattccggaacagaggccgtcatggttgccctgcgtttggcgcgggcagcaacaggaagaaagaaagtcgtggcgttctcgggatcttatcacggcacgtttgacggcgtattaggggttgccggcacaaaaggcggagccgcgtctgcgaatccgctggctccgggtatactgcaaagctttatggatgatttgattattttacattataacaatcccgattcgctggacgtgatccgcagtcttggtgatgaattggcagccgtactggtggaaccggtacaaagccgcagaccggatttgcagccgcgggcatttttgaaagaattgcgggcgatcacgcagcaatccggaacagctctgattatggatgaaattattaccggatttcggatcggtctcggcggcgcacaggaatggttcggcattcaggctgatttagtgacctacggaaaaatcatcggcggcggacagccgttaggggtagttgccggaaaagctgagttcatgaatgcgatcgacgggggtacctggcagtatggggacgattcctatccgcaagatgaggcgaaacgcacgtttgtggccggcaccttcaatactcacccgcttaccatgagaatgtcgttagccgtgcttcgccatttacaaaccgagggagaacacctgtatgaacagctgaatcaaaaaacagcctccctggttgatcggctgaatcgcttctttgaacaatcgcaagtgcctatccgcatggttcaattcggttctttattccggtttgtctcatcgcttgataacgacttgttcttttaccatctcaattataaagggatctatgtgtgggaaggacgcaactgcttcctatccacggcgcataccgcggatgatattgaacacatcattcaagctgttaaagacacggtgaaggatcttcgccgaggcggatttattccggaaggcccggattcccctgatgacggcggacataacaaatcaggggcgtacgagctttcagatgaacaaaaacaattggttatggcatcccattacgggaatgaagcgtccgccgctttaaaccagtccattatgctgaaagtggagggcgaactgcagcatacaccattaaaacaagccgtccggcatatcgttggccgtcatgaagctttacgtacagtgattcatcccgatgacgaggtacagcaagtgcagaaacggatgaatatagaaataccagtcattgattttactgttcacccgcatgaacatcggcagtcggaaattcaaaaatggctgacagaagatgccaagcggccgttccatttccatgaacaaaagcctttgtttagaatccatgtgcttacatcggctcacaatgaacatctgattgtgctcacgttccatcatatcattgtcgatggatggtcaatcgccgtatttgttcaagaactggagagcaactacgcggcaatcgtacaaggaaaaccgatttcaccgaaagaggcagatgtttcgtttcgccaatacttagactggcagcaggcacagattgacagcggccattatgaagaaggggtccgttattggcggcgtcatttctctgaaccgattcagcagccaattctgccgagcacaggttctgtccgttatccgaacgggtatgagggagaccggtgtaccgtcaggcttggacggccattgagcgaggctttaaggtcattaagcattcagatgaaaaatagcgtatttgtgacaatgctgggtgcatttcatctttttctgcaccggcttaccaaacagtcaggccttgtgatcgggatccccgcagcaggtcaatcgcatataaaacagcatgatctgattggaaattgcgtcaatatgattccggtgaagaacacgtctacttcagaaagcactttaaccggttatcttggcagtatgaaagaaagcgtgaatcttgcaatgcggcaccaagccgtcccgataacactggtggccagagagcttccgcacgatcaagtgccggatatgcgtattatctttaatttagacaggccttttcgaaagctgcatttcggaaaggcggaagcggagcccgttgcatacccggtaaaatgcaccctgtacgatttatttcttaacataacagacgcgcatcaagaatatattcttgatttcgactttaatacgaacgtcatcagtccggaaatcatgaaaaagtggggagcgggttttacaaaattgctgcaaaaaatggttgagggagattcaatccctcttgacgccatgatgctgttttccgatgaagaacagcatgatttacaagcactttatgccgaacaccagaagcgggtctcttcaataggaagcaatacagcaaatttcactgaagcctacgaggcgccgataaatgaaacggagcggcagctggcgcggatttgggaggaacttttcggccttgaacgggtcggcagatcagatcgcttcctggctctgggaggaaactcgctccaggcgacgcttatgctttccaaagttcagaagacatttcatcaaaaggtttccatcggacaatttttcaatcaccagactgttaaggaattagcacatttcattcagaacgaaacaaaagtcgtgcacctcccgatgaaggctgccgagaaaaaagcgtattacccgacatcgccggcgcagcaaagagtatatttcctgcaccaactggaaccggatcagctggcgcaaaatatgttcggccaaatatcaataacagggaagtacgatgagcaagccctgatctcatctcttcaacaagtgatgcagcggcacgaagcgtttcgcacgtatttcgacattatagatggcgatatcgttcagaaacttgaaaacgaagttgattttaacgttcatgtccggacaatgagccgggacgaatttgatgcctattcagaccggtttgtaaaaccgttccgcctggaccaagctccgttagttcgtgcggagctgatcaagattgaaaacgagcaggccgaactgctcatcgatatgcatcatatcatttcggatggttattccgtcaacatccttacaaatgaattgctggctttatatcatcagaaaccattaccggacattgaatttgaatataaagatttcgcagaatggcaaaaccaacggctgaatgaggatgccatgaagcggcaggagacatattggctggaacaatttcaagacgaaattcccatccttaacctgccgacagacggttcaaaagcggcagaacggtcttctgagggacagcgagtgacatgctccttacagccggatgtcatccgttcgcttcaagatttggcgcaaaaggcggaaaccactctctatacagtgctcctggccgcctataatgtgctgcttcataaatataccggacaagaagacattgtcgtaggcacgcctgcttcaggaagaaatcatccggatatcgaaaagatcatcggtattttcatacaaaccatcggaatccggacgaagccgcacgccaatagaacgttcacggattatctggaagaagtaaagcggcagacgcttgacgctttcgaaaaccaagactatccatttgaccggcttgtggagaaattaaatgtgcagcgggaaacaaccggaaagtctctgtttaacacgatgtttgtgtttcaaaacattgaatttcatgaaatccggcacaatgaatgtacatttaaagtgaaagaacgaaatccaggggtctctttgtatgatttgatgctcacgatcgaagatgccggtcaacagatagagatgcattttgattataaaccgggacgattcacaaaagacaccattgaacagatcaccagacactataccggcatcttaaacagtcttgttgagcagccggagatgacattgtcttccgttcctatgctgtctgaaaccgaacggcatcaactgctgacggagtgtaacggcacaaagacgccgtatccgcataacgaaacagtaacccgatggtttgaaatgcaggcggaacagagtcccgatcaggaagccgttatttttggcaatgagcggtatacgtacagacagctcaatgaacgggcgaaccgattggcgcggacgttacggacaaaaggcgtacaagcggatcaattcgttgccatcatctgcccgcatcggatcgaactgattgtcggaattttggctgttctgaaagccggcggcgcatacgtgcccattgatcctgaatatccggaagatcggatccaatatatgctgagagattcaagggcggaggttgtgttgacacagcgcagcctgctggatcaattaccgtatgatggtgacgttgtgcttttggatgaggaaaactcataccatgaggatcactcgaatcttgaatcggacagcgatgcgcatgatttggcctacatgatctatacgtcaggttccacgggaaatccaaaaggtgtcctcattgagcatcagggactggctgattatatttggtgggcgaaagaggtttatgtaagaggtgagaaaaccaacttcccattatactcttccatctctttcgatctgactgtgacctcgatatttacaccgctggttacgggaaataccatcattgtctttgacggcgaagacaaaagcgctgtgctttctgagattatgcgggactcaagaatagacatgatcaaattgaccccggcacatctgcacgtcatcaagaagatgaatatcggtggcggcaccgcaatacggaaaatgattgtcggcggagaaaatttaagcacccgtctggccaaaagtgtcagcgagcagtttaaaggccggctggacatttttaatgaatacggaccgacggaagctgtcgtcggatgtatgatttatcacttcgacgcagaacgggacaagcgggaatttgtaccgatcggcactccggctgccaatacggatatttatgtggccgatgcaagcagaaatctggttccgatcggggtaatcggcgaaatatatatcagcggaccgggtgttgccagagggtattggaaccgtccggatttaacggcagagaaatttgttgaaaacccgtatgtcccgggagcgaagatgtacaaatcaggggatttggctaagcggttgaaggacggaaatcttgtatatatcgggcgcattgatgaacaagtcaaaatcaggggacaccgaatcgagcttggtgaaattgaagcagcaatgcataacgcggaagcggtgcaaaaagccgcggttacagtgaaagaagaagaagacggcttaaaacaattatgcgcgtattacgtaagcgacaagcctatagcggctgcgcagcttagggaacaattgtcatcggagcttccggactacatgattccgtcctattttgtccaactggagcatatgccgttaacgtccaacgggaaaataaaccgtaaggcactgccagcaccagaagcgagtctgcagctgacagctgaatatgttccgccgggtaatgagacggagtccaaactgacagatttatggaaggaagtgctcggaataagccatgcggggatcaaacataatttctttgatctcggaggcaactccatccgagcggctgccttagccgccagaattcacaaagagctggatgtgaatctgtctctaaaagacatattcaagtttcctaccattgaacaattggctgacaaggcgttacacatggacaaaaaccgatatgtaccgattccggctgcaaaggaaatgccatattatccggtttcttcagctcagaggcgtatgtatttgttaagtcacacagaaggcggcgagctgacttacaatatgacgggtgccatgaatgtggaagggacgatcgatcccgaacggttaaacgccgctttccgaaaattaatcgcgcgtcatgaagcgttgcggaccagctttgatttatatgaaggcgagccggcacagcgtattcatcagaacgtcgactttacgatagaacggattcaagcaagcgaagaagtagcggaagaccgtgtgcttgatttcatcaaagcgtttgacttagccaaaccgccgctgatgcgggccggactgattgaaattgaacctgcacggcacgtgcttgtggttgatatgcatcatatcatttctgacggcgtgtccgtcaatattctgatgaaagatttaagccgaatctacgaggggaacgaaccggacccgctctctattcaatataaagactttgcagtttggcagcaatcggacattcagaaacggaacatcaagagccaggaagcgtattggctggatcagtttcacagtgatattcctgtactggatatgcctgcggattatgagagacctgccatacgcgattacgaaggcgaatcatttgaatttcttatacccgaacacttgaaacagcgtttaagccaaatggaagaagacacaggagcaacactgtatatgattttattggcggcctatacgattcttttatccaagtacagcggacaagaagatattatcgtaggaacgccatctgccgggcggactcatttggatgtagagccggtcgtgggaatgttcgtcaatacgttagtcattcgcaatcacccggcgggccgtaaaacatttgatgcctacttaaacgaagtaaaagaaaacatgctgaacgcctataaaaatcaagactatccattggaagaattaattcagcatctgcatcttccaaaagattcaagccgcaatcctttattcgatacgatgtttgtgctgcaaaatctcgatcatgctgaattgactttcgattctcttcaactcaagccgtattcatttcatcatccggttgccaaattcgatttgaccttgtcgattcaggcggaccaagacaactatcacggactgtttgaatattcgaaaaaactgtttaagaaaagcagaatcgaggttttatcaaacgactacttacacattctatcggcgattttggaacagccaagcattctaattgaacatatcggattgagcggcagcaatgaggaagaagagaacgcgcttgattctattcaattgaacttttagggaaaagcattatttctttaaattatataaaatgaggtgctccaatgtcggtatttaaaaaccaagaaacgtactgggaaaacctgtttgatgaagaagacggattaagcgcattcccttactttaaagcagcggataaagcgtcgtttgcccgtaccggctaccaggaaaaatgcatctgccgttccttatctccggaagtatctcaaagaatcatgacaatggcgaatcattccgatatggcggcctatctgattttattggcgggtattgaatgcttgttatataaatatacggatcaaacgagcctgattcttggcattccgacggtatcgaagcaaaaagccggccagtcagccgttaacaacattgtcctcttaaaaaatacgctttcaaacgagagtacatttaaaaccgtattcgggcagctgaaagaagccgttaatgattctctgaaaaatcaaaacctgccgtttagaaaaatggttcagcatctgagcgtgcaatacaatgacgagcatctgccgttgattcataccgtcgtttcgcttaacgaaattcattccttgcaatttaaagaagatactgcagccgatacgctgtttcactttgatttggagaacaacgggattcatttgaagcttttttataacggcaatctgtacgatgagcgctatatcaatcaaattgtgtcccatttggatcagctgctgtctgtgattctgtttcagcctcaagccgcgatccatacggcagagatcttaccggaagcggaaaaacagaagctattgtttgattttaacgacaccgtcagagatttctccgggagcagaacagtctatcaattatttgaagagcaagcagaaagaacgcctgagcatgcggccgtcaagtttaaaaacgaccatttgacgtacagggaactgaatgagaaggcgaaccgtttggcaagaacattgcgtaattgcggggttcaacccgatacgttagtcgccattctcgctgatcgttcattagagatgatcgtatccattatagccgtttggaaggcagggggcgcttatgtgcccctggatcctgaatatccaaaagagcggcttcaatatttgcttcatgatgcggatgcagacgttctccttgttcagcgtcatttaaaaaacagtctcacctttgacggcccggtgattgatttgaatgatgaaacatcataccatgccgatagctcattgttatcaccagcaacgggacacagccatttagcctatgtcatttatacgtcgggtacaacaggaaagccgaaaggagtcatggttgaacacggcggcattgtgaattcgctccaatggaagaaggcgttttttaagcattctccggcggatcgcgtgcttgtcttgtacccgtatgtttttgatgcgttcattttaaatttcttcggcccgctcatctcgggggcaactttgcacctattgcctaatgaagagaataaagaaactttcgccattcaaaatgccataaaacaagagagaattactcatttctcaacttctccccgtcttctgaaaacgatgatcgaacagatgaacacagaggacttcatccatgttcagcatgttgttgtaggcggtgagcagctggaaacagatacagttgagaagctgcattctctgcagcctcgcattcggatcaataatgaatacggaccgacagaaaacagcgtggtatctacatttcaccctgttcagtccgctgatgaacagatcacaatcggcagcccggtggccaaccatcaagcttatattttaggagcgcaccatcaaatccagccgatcggcgtaccgggagagctgtatgtcggaggagcgggagtggcccgcggctacctcaatcgtcctgaattgacggaggaaaaatttgtggagcatctgcatgtccctggtcaaaagatgtataaaacgggtgatctcgccagatggctgccggatggaagaatcgaatatttagggcggattgatcatcaagtgaaaattcgcggctaccggattgagatcggcgaggtagaggcagccatgttcaatctggaaaacgttcgtgaagccgcagtcgtcgcgcgggaagacgcagacggggccaaacaattgtatgcctattatgtcggcgggccttctttgaccgctgcgcagttcagaaaagaattatcccgggaactgccgaattatatgattccctcccgctttatcccattggaacgcattccgctcacttccaatgggaagattgatctgaaagctttgcctgctgctgacgaaaatacgcgggcggaatacgaatacatagccccgcggaacacaatagaagaactgctggcgtctatctggcaagaagtattaggggcagaacgtataggaattctggataatttctttgattttggcggagattcgattaagtcaattcaggtgtcatccagattgtatcaagccggatacaaggttgatatgaagcatttgtttaaacacccctcgattgctgaacttagtcagtttgtagcgccggtcagcagggtggctgatcaaggagaagtgaatggcggaaccaagctgaccccgattcagcattggttttttgaacaaaacatgccgcatgcacaccattacaatcaggccgtcatgttatattcggcggaaagctttaaagaggctccgcttcgccggacgatggaacagatcgcgtcgcatcacgatgccttgaggatgatttttgaaaaaacgccggatggatacgctccgcgaattacaggaacagatgaaagtgaactataccatctggaagtgatgaattataaaggggaaaccgatccggctcaagcgattgccgataaagcgaatgagattcaaagcagcatggtattagacaaagggccattgatgaagctcggtttgttccaatgtccggacggagatcatttgctgattgcaattcatcatttgctgattgacggagtatcctggcgtattttgctcgaagattttgcaagcggttatgagcaggcagaacgcggacaaacgatccagctcccgcaaaaaacagattcgtttccattctgggccgatcaattgtccaaatatgcggcggaaaccgacatgaaagaggagattgcttattggactgagctttcaagcataaagcctcagccattgcctaaggacactatcagcgaaggatcgttattaagtgacagcgaagaagtgacgattcaatggacaaaagaggaaacggagcaattattaaaacaagcgaaccgcgcctacaacacggatatcaacgatctgctgctgacttcgttagggctggctgttcacaagtggacaggcacggaagacattgtcgtgaatttggaaggccacgggagagaaccgattattccggatgctgacatttcccgcacgataggatggttcacaagccagtaccctgtcgtcctgaggatggaagccggaaaagacctgtcgcagcggatcaagatcgtaaaagaagggctgcgccgcatccctgataaaggaatgaattacagcatcatcaaatatatatccgggcatccggaagccgacagcatgcagctgaatccggagatatcgtttaactatttgggacaatttgaccaagacctgaagcatcaggctttgcgcatatcgccatattccacagggttatcgatgaacgaaaaccaagagagaacggccgtgcttgatttgaacggcatgattgccgaagggacattatcactgacactgagctacagcagcaaacaatacgaaagatctactatggcgcaatttgcccaagggttgaaagaaagtctgcaagaagtcattgcgcattgcgtaagccggcagcagacttctctcacaccaagtgacatcctgttaaaagatatctcaatcgacgaactggaacagcttttggagcagacgcgtgaattaggcgaagcggaaaatatttatccattaacgccgatgcagaagggcatgctgtttcacagcttatttgatccgaattcaggtgcttattttcagcaaacgatgtttgatctgcatggagatctggagattgattcattttcaaaaagcttggacggcttatcgcaaaaatatgatattttccgcacgaatttttacagaggctggaaggatcagccgctccaaattatattcaaaacgaaaaaaatcggttttcaattcaatgacatacgagagatgaaggaatcacaaaaagaagcgatgattcagcagtatgccagagaagataagatgcgggggttcgacttagaaaaaggcgcgttaatgcggctattcatccttcgtacggatgaaaagacataccgttttatctggagcttccaccatattttgatggacggctggtgcctgccgctgattacaaaagaaatattcgagaattactttgccttgcttcagcaaaagcagcctgaacaatcatcaattactccgtacagtcaatatattgaatggctcggccggcaagatgcgaaaaaggccacggcttattgggatcaatacttggagggatatgaggagcaaaccggccttcctaaggatcaccatgcagcggaagacggacgatacgttcctgaaaaagtgacgtgtgacataagctccgatctcacttcgaaaatgaagcggacggcaggccagcatcatgtcacgctgaacacgctgctgcagacggcatgggcggttttgctgcagaaatataaccgcagccgggacgttgtgtttggaagtgttgtatccggaagacctgctggaattccaaacgtggaaaccatgatcggcttattcattaacaccattcccgtccggttccggtgtgaagccggaacaacgtttgccgagcttatgaaagaggcgcaagaaagggctgtagcgtctcaacaatttgagacgcacccgctgtacgatattcaagcgcgcacaacgcaaaaacaagatttaattacacatttaatgatattcgaaaattatccggttgatcagtatatggaaagtataggccgccagaacggaacatccatcacgatctccaacgtgcaaatggaagaacagaccaactacgattttaatttgaccgttataccgggcgacgagatgaccatctcttttgaatacaatgcaaatgtgtatgatcgggcaagcatagagcgggttcgggaacatttcatgcaaatcctgcaacaagtcgtgacaaatgcggatatccgggtggatcaagcggaattgttaacggaaggcgaaagaagaacccttctgcagacgcttaacgacacggccgcgccgtttccgcagacgccggttcatcaattatttgaagagcaatcgcagcgtacgcccgatcaagcagccgtcattgataaggacaggcagctcacgtacggagagctcaataagcgggccaaccgactcgcgcgaacgttaagagcgaaaggagtccagacggatcagcctgtagccatcatcacgagaaacagcatcgaatcggtggtcggaatccttgccgttttaaaatcagggggagcctatgtccctatagatccggaatatccgcaagaccgcatacggtatatgctggatgactcccaagccggaatcgttttaatgcagcgggacgtcaggaaacagcttgcctatgaaggcgtcacggttttacttgatgatgaaagttcttatcaccaagatggctctgaccttgctcagataaatgatgtgagccatttggcatatgtcatttatacgtcaggttccacaggccggccgaaaggcgtactaatcgagcaccaaggcttgaccaattatatttggtgggcgaaagaggtttatgtaaaaggcgagaaagccaacttcccattgtattcgtcaatttcttttgatctgacggtgacttctattttcacgccgcttgtcacaggaaatgcaatcatcgtctatgacggagaagataaaacagctctgcttgaatcgattgtgcgagacccgagggtggatatcattaaattgactccggcccatttgcaggttttgaaagaaatgaacattgccgatcaaacggctgtccgaagaatgattgtgggcggggaaaacttaagcacccggttagcccgcagcattcatgaacagttcgaaggccgggttgaaatatgcaatgagtacggaccgacggaaaccgttgtcggctgcatgatttaccgttatgatgccgtaaaggacagacgggaatcggtaccgatcggaaccgctgcggcaaacacgagcatttacgttcttgatgagaatatgaaacccgcgccgatcggagtgccgggagaaatctatatcagcggcgccggtgtggcaagaggatatttgaaccgtcccgaattaacggcagagaaatttgtcgatgacccgtttgaacccggagcgaagatgtataagaccggagatttggcgaagtggctggcggacggaaacattgaatatgcgggcagaatagatgaacaagtgaaaatcagaggttatcgtatcgaattaggcgagatcgaggcggcactgcttcaagaagaagcgatcaaggaagctgtcgttacagccagagaggatgtccacgggtttaaacaattgtgtgcatattacgtaagcggcgggcaaacaacggctgcccggctccggaaacaattgtctcatacccttgcaagttatatggttccggcttattttatcgagcttgatgaaatgcctttaacttctaacggaaaaataaacaaaaaagggctgccggctccggatttcgagctgcaggacagagcagagtataaagctccccgaacaaaagcggaagaaatattagtttctgcctgggaatcggtattaggcgctgaaaacgtcagtattcttgataatttctttgaccttggcggagattccattaaatccattcaagtatcctccagattaaatcagcaaggatacaaaatggaaatcaaagacttgtttcaatatgcaacaattgcagaattgagtccgcatatcaagcagaatctgcgtatagccgatcaaggtgaggtcaaaggaaaagtcagcctgactcctattcagcattggtttttcgaacaaataacgacagatcagcattattataatcaagccgtcatgctgcatgcgccggaaggttttcaggaaacgcagcttcgtcaaaccctgcaaaaacttgctgaacatcacgatgcgctccgcatgacgttccggactacggaaaatggctgcgaggcacagaatgaagaaatcgcccaaagcggactgtaccgcttagaagtcctgaatctgaaagaagattccgatccgggacggacaattgaagccaaagctgatgagatacaaagcagtatgcgtttaagtgatgggccgttaatgaaagccgggttgtttcaatgcgcaaatggagatcatctgctcatcgccatccatcatttgattatagacgggatttcatggcgcattttactggaagatatcgttagcggctacaagcaagccgagaatgggcgagtgattcaactgccgcaaaaaacagactctttccaattatgggctaagagactttcagaatatgcgaaaagtgaaaccataaaacaggaacaggaatattggacaaagatcgaacaaaccgaagtcaaaccgctgcctaaagattttcatgaaacccatacaactgcaaaagacagtgaaacagcaactgtggaatggacgaaagaggaaacggagctgctattaaaacaagcgaatcgcgcttataacacggagataaacgatttgcttttaacttctctcggtctttccatatcgcattggtcaggactgaaacaaattccgattcatttagagggacacggccgagaacagattatacaagatatagatatctcccgcacggtcggatggtttacaagtctgtatccggttgtgctgcacgcgcagccgggcaaagagatctctgattatatcaagacgaccaaagaaggattgcgccaaattccgcataaagggatcggatatggaatagcaaggtacttaagcggcggaatgccatcgaaactcaatcctgagatcagctttaactacctgggacagtttgaccaagatttacagcagcatggggttcaattatcttcttattcttgcggttcagactctagcggaaatcaagaaagaccgtatgtattgaatataaacggaatgatcaccgacggccggctgaagcttacgatcagctacagcagcaaacagtacgcaaaagaaacgatcatgcggttatcggaaacgattcaaagccgcctgcggacaatcattacgcattgcgtccatagagaacaatcggaactgacgccaagcgatattttgttaaaaggcatgtccattgacgaattggatcagctcctcattcaactgccgcatgcaggtgaggttgaaaacgtgtatccgctcactccgatgcagaaaggaatgctcttccacagcctgctggacgaggcctcaagttcttattttgaacaagcatcgttcgatttgcagggagaattaaagattgattggtttaaagcaagccttgaacgattatttgaaacatacgccgtgctcagaacccgtttttacagcggctggaacgatactcctttacaaattgtctataaaacgcaaacaccgcaaattcattttgcagatttgcgtgatatagaggagcacctgagagaggatgcaatcgcagcctatcaaagagaagataaggcaaaaggatttgacttggctcgggatccgctgatgcgcatagcgattttccgtatggaagaccgcaaatatcatttgatttggagcttccatcatattgtgatggatggctggtgcctgtctcttatcacgaaggaagtgtttgatcattatcgcgccttacaagaaggcagggaaccagaaccgtcatcggcagctccttacagcaactatatcgagtggcttgaccgccaagatcagggagcggcaaagcggtactggagcgggtatctcgaaggatataaaggtgaaaccacgcttcttcataaaatagagcagcatgaacaaaaagaatacgcctatgccaatgtgacctgccgatttgatcacgaacagacaaaacaattacagcagatcgcaaatcagcatcaggttacattaaatacgttgatccaaacgttatggggagttttattacagaaatacagcgggtccgcagacgttgtcttcggcagtgtcgtgtcgggaagaccggcggaaattcctgatgtggaacagatgatcggcctgttcatcaataccattccggttcgcatccgctgcgatgaggacagcacttttgctgatacggtgcaaatggttcaacaaaacgctctggcttcccaatcatacgatacctatcctttatacgaaattcaggcccaaacggaacaaaagcagaacctgattgaccatatcatgatttttgaaaactatccgatcggtcagcaggtcgaagagacgggacatcatagtacggagctgaacattacgaattttcatatgctggaacactcccactatgatttgaatgtagttgtcatacctggcaaacagctggccgttcatttcggttttaatgaaaacgaatatgaaaaatcagaagtggagcggatctgcggacattttgaacagctcatgcagcaagtattacagcagccgtctgtcaaaatagaagaattggagcttctctctaggcaagaaaaagaacatttgctcagccgctttcagtctaatgacatgcattacccgcttgaacaaacgatacatgagctgtttgaggaacaggcgcatcgtactccggacaatacagcggttgtattcgagggtaaacaactcacctacggagaactgaaccggcgtgccaatcagcttgcgcgaaccttgcaggcaaaaggtgtgcggaacgataagcttgtcggtattatgactgaacgctcgcttgagatgattgtaggcatcttgggagttttaaaagcgggcggcgcatatttgccgatagatcctgattctccgtctgaacgcatcagttatattttaaatgattcaagcatcagcgtattgctttaccgcgggaagctgcaggatgacatcggcttctcaggaacatgtatcgatctcatggaggaacatttctatcaccaaaaagacagcagtcttgcactctcttatcagtccagtcaactggcctatgccatttatacttccggtacgacaggcaatcctaaaggcacgttaattgaacatcgccaggtcattcacctgattgaaggacttcgacgccaaatttactctgcctacgatgcggagctgaatgtagccatgctcgctccatattatttcgatgcttctgttcagcaaatgtatgcttccttgctgtcaggacataccttgtttattgttccgaaagagattgtgtcagacggtgctgccttatgccgttattatcggcagcattcgattgacatcaccgacggaacacctgcccacttaaagcttttgatagctgcaggtgatttgcagggagttccgcttcagcatcttttaatcggaggagaggcactttccaaaacgacggtaaataagctcatgcaattattcggcgatcatggcgcttcacctgggattaccaatgtatatgggcctacggagacttgcgtagacgcgtctctgttcaacattgaatgttcttccaatgcgtgggcacgcagccaaaactatgtccctataggcaagccgttaggcagaaaccgcatgtacattcttgattcaaaaaaacggctgcagccggcgggcgtccaaggcgagctgtatattgcaggggacggcgtcgggcggggttacttgaacctgccggaactgacggacgaaaaatttgttgccgatccgtttgtaccggaggaccgaatgtacagaaccggtgatctggcccgccttctgccggatggaaatattgaatatatcggccggattgatcatcaggtgaaaattcaaggttttcggattgaactcggtgaaatcgaatcggtgatgctgaacgttcctgatattcaagaagccgccgcagctgcccttaaagatgcagatgatgaatattacttgtgcggatactttgctgcggataagacaatacagatcagtgaacttcgcgaaagaatggcccggcatttaccgggatatatgatcccggctcaatttgtgcagctggataagatgccgctgacgccaaacgggaagttgaatcgccagttattgccggctccggtcaaaaagcgtgacggcggcatagagtacgtcccgccgcaaacttcggaagaaatccagctgacagcaatttgggaagatgtcctcgggttagagcaggtggggatcagagatcacttttttgagatcggcggacactccctgcgggcaacggcgctgattgcaaaaatacaaaagcaattgcatgtccaaattcctttgcgggacgtcttccgtctcccaaccattgaacagctcgcacagacgatcacgaagacggagctgaccggatatgctgcgattcctgcaattgaaaaaagaccttattatccggtatcctcagcacaaaaacggttgtacatcctgaatcacttggaaggcggagaactcagttacaacatgctgggactgatggctgtcgaaggcaagcttgaccgtgacaagctgcagcaagccttccgcacgctgattttgcgccatgaatctttgcgcaccggttttaaaatggctgacggagaacccgttcagtatgtcttagatcacgcaaagttcgaagcagagtggtatcaggcagaagaaaatgatgcggacctttatatccgcaaatttattcgtccatttcatctggatgagccgccgctgcttcgcgtggggctgattgaacttcaacctgaccgcggaattctgatgtttgatatgcaccatattatttctgacggaacatccatgagtgtattgattaaagaatttatccgcatttatgaaggagaaacattaccgcctttgcgcatccagtataaggactacgcagtatggcagaccggcgaagcgcggttaaaacagatccaaaatcaagaagcctattggttagagctgtacagcggcgacgttcctgtccttcatctgccgaccgattatatccggccgtcggcacgggattttgcgggagccacaatgcagtttacgcttgataagcaaaaaagcgccgggttaaagcagctggcatcccaaactgaatcgactttatatatggtgctccttgcgtcttatacattattgctttcaaaatacagcggccaggaagacataattgtcggcagtcctatagcgggaagaccgcacgccgatttggaaccgattatcggaatgtttgtgaatacattggccatgagaaattaccctgaaaaagggaagacgttctctcagtatctgtccgaggtgaaggagaatgcattaaaagcttatgagcatcaagattatccgttcgaagcgctgatcgatcaactgaatatcgcaagagacttaagccgtaatccattgtttgacaccatgtttgtgcttcaaaacacggagcaggaacagttagagataaatgacgtcactttcaaaccatatccaagcgaacatacgatggctaaatttgatttaaccttaacggctgtggaagaagagtcgggtattcagttcacaatggaatacttgacggctctgtttaaaccggaaacgatcgaacgcatgatggggcattttgtgcagctgattgattcgattattaaacagcctgatgccgagctggctcgtctgaatatgatgaccaaggaagaggaaggagacattcagcaactctttaacgatactgcagttgcggaaaaacgaattccgacaacgattcatcagctttttgagcagcaggctgagcttaacccggatcatgaagccgtcatgtttggaattcagacactgacttatcgtcagctgaatgagcgttccaatcagctggcgcgcatccttcaagataagggggcctgcactgatcaggttgttgccgttctcacggatcgctcagcacatatgatcatcggcattttagccatattaaaggccggcgcagcatttcttcctattgatccggagcttcccgaaaaacggcgggcttttatgctgaaagacagcggcgccggtgtgcttttgacttgtgcaggccacgctattccgccgcgctttgaaggagaagtgcttcagcttgatgatccgatgatatatcaaggcagagcagacaatcttaatctttcctgctcggaaaatgatttaatgtatgttatttacacgtcaggcacaacggggcagccgaaaggagttcagctggagcacaagacgatgacgaatctgctcgcttatgagcaggatcatacgcagcttcgctttgacagagtgctgcaatttgccgcgatgagctttgatgtctgctatcaagaaatgttctccgcgctttcaagcggaggaacactctttatcatcggcaatgaggcaaaacgtgacatacgtcagctcaatgattttgtcagaacgcacgggatacaaacagcattcctcccgacagcgttccttaagctccttgcctcagagaaacaatatttcgaaccgtttgccgcgtgcgtggatcacatcatcgctgcgggagaacagctcatcgtaacaagtatgctgcgtgacatgctggcacgccatcaagtcacattgcataatcattatggcccgtcggagacgcatgttgtgaccatgtataccgtcgatcctgatacagatcaggagcttcagccgatcggcaaaccgatttcaaatacggagattttcattttgaatgaagccggaacgcttcagcctgtcggaatcgtcggtgaactttgtatttcaggagcgagccttgccagaggctatcataacagggagcctttgacactcgaaacttttgttccgcacccatatgactcgaatcagcggatgtataaaacaggcgatctggcccgttaccttcctgacggaaacattgaatatgcgggaaggagagaccaccaggtcaaaatccgcggttaccggattgaactcggtgaggtggaggccgctcttctcaagcacgtacaggaagcagttgtcctatcaaaagaaaataccgatggccaaatcgatttatatgcctattttacagcggagcaatcactctcgatcagtcagctgaaagaaaaacttgctggccaaataccgggatacatgatcccttcatacttcatccagcttgagaaactgccgctaaccggcaatggaaaagtaaatcgaagagcattaccgatgcctgaagcaggtttacaaacgggaaccgactacgttgctccgcggacgaatatggaagagcagctgatatgcatctggcaagacgttttgaaggtaaaagaaataggtgtaaaagataactttttcgatttgggcggccactcgttgcgggggatgacgctcatcgccaaaattcataagcaattcagcaaaaacatttcattaagagaggtctttcaatgtccgacagttgaggaaatggcaaaggcaattgcaggagctgaaaccaacgggccggattacattccgaaagccaaagcaaaagatgtctatcctgtatcttccgtgcagaagatggtttacctgtcaacacaaatagaaggcggagaactgagctacaatatgccgggaatccttacattagaaggaaaactcgacataaatcgcttgcaaaccgctttccaaagactgatccagcgtcatgaatcactgcgtaccggttttgagctggtccgcggagaaccggtgcaggtgatcaaaccgcaagcggagttttcgatggaaagatacaaggcaacagctgacgaggttgaggaatgtttccgcaccttcgtgcggccgttcgatctcagccaggctccattactcagggccggactcatcgagttagaacaagacctgcatattttcatgtttgacatgcaccacatcatcacggacggcgcctccatgaatatttttgtcgaagaactgattcaattgtatgacggcaaagagttagctccgctccgtattcagtacaaagactttacggaatggaaacatcaaaaagagcaaagagaacgaatcaagaagcaggaagggtattggcttggtgtatttcatgaagagctgccttcatttgagctgccgaaagattttgcgagaccgccggttagaagctttgatgggaaaaggcacaattttacgctcgataagactgtcacccaagggataaagcagctggaagaattgaccgggacgacagcttacatgattttgttctcggcctattccatactgctggctaaatacagcggtcagggtgatatcgtcgtcggcacacctattgcggggagaccgcatgcggatttggaacccattatcggaatgtttgtcaatacattagccatccgcaccgctccgatggcggaaaagacatttttggattatataacggaaacgaaagaaaccatgctgaaggcttttgaacatcaagagtatccttttgaagaattagttgaaaaactgggtgtaaaacgggacttaagccgcaatccattgtttgatacgatgtttgtcctgcaaaatacggaacaaacggatattgaagtggactctctcgcagtcaggccttatgaacaaacagagacggcagccaagtttgatttacagctgaacttcttaatagatcaagatgagattcagggcagttttgattactgtacaaaactgtttaaaaagaaaaccattgctgtattggccaaggattacgtcatgatcctttcggcgattatgagaaacccatccattcctttaaaagacattcaattaagcgaaaaagtaaacaaaagtaaacatctcgcaagcacaatcgaattggatttctaatcacgggggcagcggctgtcccggcatgaatgccgcggctgccgccagctgcctgaaaacaggaatgaaaccaactggagggatatgaatgtcagaattcaaacaacaggagttgttctggggccgaatgtttcacacggaagaccgtcccggtgcattcccttcgtttcaagtgtccgactcaacagtaaagcgtgatataacaagcggatctgactgtattcacagttcattgagtgcggaggtatcacggcgcatcctgaccatgacgaaccaaacgccaatggccgtctatctggttctcctggtcggaattgaatcccttttatacaaatacacgggggatgagggagtgattacaggggttccagcctttgaagacgaaactgatgaagatcttcgttcagaccagctcatgttaatcaaacagcagatcaattccggcagtacgtttaaatcaattttccatgaattgaaacatacgctggacgaagcgatcttatatcaggacgttccctttgataaaatggccggacagctgaggctgaactacaatgcaaatcatttgccgatcatccatacagttgtttcactagagcaaattcattctgatggtttcatagaaacggctgctgcagatgctttatttcagtttgctatgggtgaagacttgattgacctaaaattatgttttaatgaacaagtctatgaccgtcagtatatgatgcaggtgctcggacatttaaaccggctattttctgtcatattatttcagcctgacctcccctcggccaagtggatattttgccagaatcggagacacatacacttctcgttgacattcaaactgcgaaaactgaatatccgcgggataagacggtttatcagttattcgaagaacagatgaaacgaacaccggatcaagcagccgttatttacggagaaaagcaattcacatatcgtcagctcaatgaacgtgccaatcaattagcccgaacgttaaggaaaaagggggtaaagacggaccggctcactgcgattatttgcgagcatgagatcgaactggtcgtgggaatattggccgttttaaaagcgggaggggcctatgtgccaattgatccggattatccgaagcatcgcatacagtatatagcagaagactcccaagctgatatcatcctgacgcagagccatcttcaaaaacagttggaacttgcgggcacaatggttttcctcgatcaggaaagctcttaccacgaagacggctctgacctggaaccgatcagcagtacgaaggatttggcttatgtcatttatacgtcaggctccacaggcaagcctaaaggagtggcaattgagcatcagggcttaaccaattatatttggtgggcccgccgggtctatgtcaaaggggaaaaaaccaactttcccctatattcgtccatcgcttttgatctgacgataacgtctgttttcactccgctaattacaggaaattccattattgtctacggaggagaaaacagtgctgccttgcttgattgcattattcaggattcaaggacggatattatcaagctgaccccggcgcacttgcagttattgaaagagatgaatatccctgctgagtgcaccattcggaaattcattgtcggcggtgacaatttaagcacgcggctcgcccgtagcatcagcggaaaattcggcggaaaaatcgaaatttttaacgaatacgggcctacagagacagtcgtcggctgtatgatttattcctttgatccgcaaaacgacagacgggaatcagtgccgatcggaaccgccgcggacaacatgaacattttcgtgctggataagagcatgaagccggtgccggccggcgttccgggagaaatctatatcagcggggacggcatcgccagaggatacttgaacagagcggaattaacagcagaaagatttttgcagcacccctttgtgccagaggtgaaaatgtaccggacgggagatttagcaaggcggctcccggatggaaatattgaatatttaggccggatcgaccaccaggtgaaaatccgcggttaccgcattgaaatcggggaagtcgaatccgcatttttccaaataccgccgattcaagaagctctcgttacggcacaagaaaccaacggggaaacatccttgtgcgcctattataccgcacagcattctttaaccgcaggcgaaattcgggagcgcctgtcccggcaacttccgtcctatatgatccctgcttattttgtacagctggcagcgatgccgcttacttccaacggaaaaatagatcgtcaggctctgcctgctccaacgggaaatctcactggaaatccttatacagctccgcggacagaactggaaaaaatactggccggggtgtgggaatcggtattaggcgcagaacaggtcggaatcgatgatcatttctttgagctgggaggagattcgattaagtcgattcaggtgacctcaagcttatatcaagccgggtataagcttgacatcaaacacttgttcaaacacccgacgatctccgggcttgctccttttattgagcccattacccgaatcgcagaacaaggggagatcaaaggccgtaccttattgacgccgattcagcattggtttttcgcccggcaataccctgatccgcatcattataatcaatctgtcatgctttattttaaagggggtttggacgaatcgaagcttcagaaagtcatgaagaagattgccgagcatcacgatgctttgcgcatggtctatgttcagggagatcatgaatacgaagccagaacccgcgggatcagtgaaggagaattattcagcctcgacgtgttctctttactcgaagaaaacaaccctgccgaaacgatagaaacgatagcaaatgacattcagcaatccatccatttagccgatggaccgctcatgaaactgggattgtttcaatgtcaggatggcgatcatttgctgattgcgattcatcatctggttgtagatggcgtatcgtggaggattttacttgaggatataacgtcagcttatgagcagctccaaaacggagaagcgctcacgctccctaagaagacggattcctatctgttatgggctgaacgattgaaacgttatgcagaaagtccggaatttgaagcagaaaatcaatattggcttgagcagaaacatatctcgcaacacaaattgccaaaggataatgagcaggagaccggtctggccgaagaccgggaaacgatcatcgtccaatggacagaggaagaaaccgagcatttattaaaaaaatcgaacagggcctatacgactgacattaatgatttattgctgaccggactcggaatggctgttcatcgctggacggggcatgaagaaattcatgttcatctggaaggacacggcagggaatctatttttcaagacgttgatatttcacgtacagtgggctggttcacaacccaatacccggtttctcttcaaatccaggcagaccgggacatctcccagcggattaggacggtgaaagaacagctgcgtcagattccccaaaaaggaataggatatggcctgatgaaatattcgtccgatcatccgaaggcatcagaatggaccggacatccggaaatcagcttcaattacctcggacaatttgatcaagatctcgaaaatggaggaatcgaagtatctccttactccggagggaaaattgcaagcgacagacatcccattgcctatacgcttgacattaacggcatgatctcagacggccggctgtcattggccatcagttacagcggtaaacaatatcgaagagaaacgatggaaacatgtgcagctctcttaaagaacagcctaaaagaagtcatcgaacattgcgcagctcaagaagacattcacctgacgccaagcgatatctcactgaaggacataacaatcgaggaattagatcaatttgttcagcaaacacaacatatcggcgagattgaaaatatatatccattaactcccatgcagaaaggtatgctgttccatagtttaatcgattcggcttccagagcttactttgaacaagccgtttttgatctcaaaggcggcttggatatcgaggcatttacaatgagtttgtcgcagctggcggaaagacatgagattctccggactcatttttatacggaatggaaagatcagcctttgcagatcgtattccgaaaaaaaccgatcgaaataactgttgaagatattcgaagcatgaagaataaacaacgaaacgagttcattgccggctttgtacaaaaagataaggcaagaggattcgaccttatccaagatgcattaatgcgcgtatcaatccttcgtacagaggatgaccaagtccgattgatatggagcttccatcatattttaatggatggctggtgtctgcctcttattacgaatgaagtatttgaaacctattatgcgattcttgatagaagaaaagcggagcgggaagtcgtcaccccgtacagccgatatatcgaatggctggaagaccaggatcataagcacgcttcagcctattggcaaaaatatttggacggttatgaaggacaaactgttttactgaaagaacctgtctcaaaccaagccaagggatatcaaaaacaaaggcttgcatgccggctcggaaaacagctgtcagaagaaatcagacagactgcaagcaagcatcacgtcaccgtgaatacgttcattcaaagtgcgtggggactattgctgcaaaggtacaacaacagtcaggatgtcgttttcgggtcggttgtatccggccgcccggcagaaattccgggtatcgagtccatggtcggcttatttatcaacaccattcccgtccgtattaccgctcagcctggaatgactgtggaacaagtgttgaaaatgagccaggagcaggcattggcttctcaagggtatgatacatttccgttatatgaaattcaggctcaaactgaacaaaagcagcagctgatcagtcatatcatggtatttgaaaattatccggtcgagaaacaaatggagcatatgaaaccgaatcgtgacgcactggacattatcaatttccatatggaagagcatacccattacgatttcaatttcattgtcatgcccgcgggagaaatcgacattcattttgtatacaatagcaacgtctatgatcatgcaagtgtcaagcggatggaagagcattttatgcaaatcattaagcagatggtgaacagtcaggcgattcgcgtccaagacttggatatacttacgggggatgaacgttcgctccttatagaggcatttaatgatacggaagcagattatccaaaggaaaagacgcttcataaattgtttgaggaacaagcacagcgtacgcctgatcaaacggctgtcgtatacggggaaagccagctgacataccgggaactgaatgaaagagccaatcaacttgcccggacattgcaatcagaaggcgtgcagccggatcagccggtcgggattatggccgaacgttccttggaaatgatcgtaggactcttcggaatcttaaaagccggcggcgcgtatgtgccgatcgatccgagctatccggaagaacggattcactatatattggaggattcggatacgaagctgttgttagtacagagtcacttgaggaaaagcgtgccttttacgggaaaagtgcttgacctggaagatccgcgattctcttgggaagatggttcaaacttgaaacagactgccggaccgaatcacttagcttatgttatctatacttcgggatcaacaggccgaccgaaaggggttatggtggaacaccgatccgtaatcaaccgtctcgtttggatgcagaaacattacccgctggataagcaggatgtcattctgcaaaaaaccccaatcacctttgatgtatcggtgtgggaattgttctggtggtcgatgactggttctaaagcggtattgcttccaaacggaggagaaaagaaccctgacgtcatcttagatacgattgcgcagaaaaatgtcaccattatgcattttgtgcctgcgatgctgcatgcttttcttgagtccatggagcaaaaatccgacgaggaattaaagagaaagctggcatcattaaaatatgtatttgcaagcggcgaggctttgacgcctgcgcacgttgcggggtttcatcgcttgatcacaccggcgggtgaggctcaaatcatcaatttatacgggccgaccgaagcgacgatcgatgtatcgtattttgaatgcgaagcgggagaaacgcttaactcagttccgataggtaaaccgatttccaacattcaattgtatatcgtacaccccgaatcggaatattttcaaccgctcggtgtggcaggagagctgtgtatcgccggagacgggctcgcacggggctatttgaaccgcccggagctgacggctgagaagtttgcagctcacccatatgaagcagggaagctgatgtaccgtacaggcgacttggcaagatggctgcctgacggcaatatcgagtatttgggaagaattgatcatcaagtgaaaatccgaggctaccggatagaactcggcgagatcgaagcatctttactacaactcgatgctgtcaaagaagcggtcgtcatcgcgattgaaaaagagggctcaaaacagctgtgcgcttacttgtcaggagacgagtcattaaatacggcgcagctgaagcgtcatttgctgaacaatctgcctacgtatatgattccggcttattttgtacaagtagagaatatgccgataaccgctaatggaaaaatcgatcgaaaagcgttgccggctcctgagggaaataggcttaccggaaccgaatacgcagcgccaggaacgttaattgaaaagcagctggccgatatatggaaggatattttagctctgcctgaccccgggattaaagatcacttctttgacgttggcggccattcacttaaagtattgcagctcattcatcaaattaacgccagtatgggaatcaacatgcattatcaagccgtatacgattttcctaccatcgaaacaatggcacgcgccattcaagcggccgttttcgaatccgagacggataacgtattcgtcaagctgaatcaggaagattcaatccctgtgttctgtttcccgcctttaatcgggtatggactcgtttataatgaaatggcgaaaagacttgacggcgtcagcaccatctatgccgctgatttcttagaagagccgtctcatgggaaagagatcgttgaccggtatgcagaaagcatgataagcattcaagaacaagggccttttgttctgcttggttactcttccggatcgaatttggcttttgaggttgccaaagccttagaaaagcgggggcgcaccgtatctgatgtgattatgctggattctaaaatcaccgattcggtaactcatttatcggaagaggaaatccaagagatcgtccatctgaatatggacattattccggactactacagagaaatattaaccattccttcgattaaggataaaatcagaggctatcttgcgtatcacaatgaactgatcaattccggcgccgttaacgccaacatccatcatttgctatgcggcgatgtaaccgatgataggggctggacacaatcaacagcacagcattatcttgagtacaaattaaaaggagatcacgtgacgatctttgaacctcacaatatcgaagaaaatacggatgcaattcgatctattattaaacggattgaagaacggcatcatcacggacttgttcttgaagaacaactgtcaataggatcgtttgctggcgacacgaagtttgacaaaatgtaagtgatcaagtgtaaaacgccgctggcctggcactcagcggcgttttttattaaaaaggcgagagtcatactcctgtgttcgcaaggcttactccagagccgttctccatgactggttgtcatcaaatggtaaaaaaatcatcatacattttaaggaaaaagaaggatgtcaagttattagaaaaaagtgtagcgtatgtttatgggtactagctctattattgagttgcttaactgcggagtctgctttttactgccggtactgcaatttggtctcaaatggtaaaagttccccgaatttaaagaaaaaggaggagtgttaagttatgtgtaaaaaatgttgcgtatgcctatgggtccttgctttattattgagttgcttcactgggaagtctgcgtatgctgccagcactccaattgcaaaacatgttgggaattcaaatccgcttatcgaccatcatctgggcgcggatccgtttgcgctgacctataacggaagagtctatatctatatgtcaagcgatgactatgaatataatagcgacggcacgattaaggataattcatttgccaatttgaataaaatatccgtcatatcttcagcggatatggtgaactggacagatcacggagcgattcccgcagcgggtgccaatggggtgaatggcggccgggggattgccaaatgggcaggagcatcatgggccccgtcagccgcggtgaaaaagatcaacggtaaggataaatttttcctttatttcgcaaacggcggcggaggtatcggggttctcaccgcagacagcccgaccggtccgtggacagatccgatcggaaaaccgctggtgacgccaagtacaccaggaatgtccggtgttgtatggctttttgatccggcagtattcgtagatgatgacggtaccggttacctatatgccggcggaggcgttccgggcggttcaaatccaacgcagggacaatgggccaatcctaaaacagcaagagtcatgaaattagggcctgatatgaccagtgttgccggaagtgcatctacgattgatgcgccttttatgtttgaagattcgggaatgcataagtataacggaaaatattactattcctattgtatcaatttcgggggcgcgcacccggccgataaacctccaggtgagatcggctatatgaccagctcaagtcctatgaattctttttcgtatagagggcactttctgaaaaatccgggagcatttttcggaggcggcggaaacaatcaccatgctgtttttaattttaaaaacgagtggtatgtggtgtatcatactcaaactgtcagctccgctctttacggggccggcaaaggataccgttctccccatataaataagcttgtgcataatccagatggctccctgcaagaggtagcggcaaattttgcaggtgtcaaacagctatccaacttgaatccatataaccgggtagaagcggaaacgtttgcctggaacggacggattttgacagaggcatcctcagcacccggcgggccggtcaataatcaacatgtcacaaacattcataacggagactggattgctgtaggaaatgcagatttcgggtcaggcggtgccaggacgtttaaagcaaatgtagcgtccgctctcggcggaaaaatagaagtgcgactagacagtgcaaacggtaagcttgtcggaaccttgaatgtcccttccacaggcggaacgcaatcctggagagaaatagaaactgcggtaagcggcgcatccggtgttcacaacgtattctttgtatttaccggaactggtacaggaaacttgtttaatgttgattactggcagtttacacaaagataagcaaaggtacgttttctaagtctataaaagataaatgaaggagaggaaaaaatgatgtcgagcgtaaaaaaaccaatttgtgtattattggtatgtttcacaatgctgtccgtcatgctgttaggaccgggagttactgaagtttcagcagcaagtgatgcaacagttaatatatctgcagaaagacaagtgattcgcggttttggaggaatgaatcacccggcttggattggagacttgactgcggctcaacgggagaccgcttttggcaatggacagaatcagttaggtttttcggtcttaagaattcatgtagatgagaatagaaataattggtacaaggaagtggagactgcaaagagtgcgatcaaacacggagcaatcgtttttgcttccccttggaatccgccaaacgatatggttgagactttcaatcataatggtgacacatcagctaagcggctgagatacgataagtacgccgcatacgcacagcatcttaacgatttcgttaatttcatgaagagtaatggtgtgaatctgtatgcgatttctatgcagaacgagcctgattacgctcacgaatggacatggtggacgcctcaagaaatcctgcgtttcatgagagagaatgccggttccattaatgcccgtgtgattgcgccggaatcatttcaatacctgaaaaatatatcggaccccattttgaacgatccgcaggcgcttaggaatatggatatcctcggaacccacctgtacggcactcaggtcagtcagtttccttatcctcttttcaaacaaaaaggagcggggaaggacctttggatgacggaagtatactatccgaacagtgataacaactcggcggatcgatggcctgaggctttaggtgtttcagagcatattcatcattcaatggtagagggagattttcaagcttatgtgtggtggtacatccgcagatcatacggcccgatgaaagaagatgggacgatcagcaaacgcggatacaatatggctcatttctcaaaatttgtgcgccctggctatgtaaggattgatgcaacgaaaaatcctgaaccgaatgtttacgtgtcagcctataaaggagacaataaagtcgtgattgttgccattaataaaaataacacaggggtcaaccaaaacttcgtgttgcagaatgggtctgcttcgcaagtatccagatggatcacgagcagcagcagcaatcttcaacctggaacggatctcaaagtaacggataatcatttttgggcccatctgccggctcaaagcgtgacaacatttgttgtaaagcgttaaaggcatcagcattgcattaagccaattttcttactcggaaaagaaaattggcttattttctgtgggagagaatgttgattttttaacgatacacggacattgggtataataatgacaatgacttcaaggagtgatcaatatatgtcacggcttcacagcaaagtattaatcatagacgatgaaaaagaaattttggaactgatcaaaaccgtattaataagagaaggcattgatcgcgtagtgaccgcttcaactgcccgtgacggattggctcaatttcatcaagaaaatcccgatcttgtgatattggatatcatgctgccagacggtgaaggctatgatatctgcaagcaaataagggacatttcacacattcctattatctttttgtctgcaaagggggaggaaacggataaaattgtaggacttgccatcggcggggacgactacattacaaaacctttcagccctaaagaagtcgcataccgggtcaaagcgcagctgagacgggtctcttacttacagccttctcaaaccggaaccgtgataaaaaaagggccatttgaattaaaccaacaacaagccgagctcaccaaaaatgaagcggctattgagctaacacctaaagaacttatgcttatggcctattttctgcagcatcccaatcgggtgatcagtaaagaaacactctatcaagctgtatggggagaagactttttcggttctgacaacacggtgatggttcatatacgcaggctccgtgagaaaatagaaactgtcccatcaaaaccagactttctcgtcactgtgaaagggttaggctacaaatttgttgtaaaggatgcgtaaggatgaattggcgattaacaggcagatacatggtatctgtcatcatagtgaccatcattacagtcttcattaatttatttatttttatgttttggctcgttttacaggcgaacagccaacatgacgaagaaagtacacctgaaactttcacaagatcattcggacaatatgtcacgttatcgaacaagggtatcacagtaaacaaagagggccaaaaagctttaaaagagcagaatgcatggattcaaatattagatgaaaacggacaggatgtttatcatgatagagaacctaaaggactgaagaaaaaatatacgcctattgaaattgtaaatttacataaatataaggatgaacaattattatcaaccatttacgccggcggaaaaaaagtaaacggcaaggagtacagttactttatagggtttaaaaatccctctctcggaaaatttgtcctctcatatgataccaaggaatttgtgacgaagttcaatacaggaaccatcatattattatcaatagatgcattgatcgcgttactcattggctatctattcagccggcagctcacaaaaccgctcggccgtgtcattcaaggaatccagcggttagctaatggagattatacgatcaaaatgaaatccaaaggcatttataaagatgtgttctataatgtcaatcacttatcggaacaactatctttaagcaaaaaagaaaaagataaattagagcaaatgcgtgaagagtggatcagtcatatttctcatgacattaaaacaccattagcatctattcaaggctatgcagaaatcatcaaagatccgaattatcatctcacagtcgaacagatcagagattacgcccggatcattgagagtaaatcgctctatatgaaagatgtgatggaagatttaaatttaacgacaaggctgaaaaacaacgatgtgatgttaaataaagaacgggtaaaccttgtatcgctgctgcgggaaacgttaattgatattttaaacgattcgagatatgcggataagtccattgagcttcaaacgaacctggaaaaactgatgctgaaccttgatgcgatattgattcggagagcggtcacgaatctcattttaaatgccctcgttcacaatgatcccgatgtgaagatcgttgtacagcttgaacaaaaagaacgaactcatgtgacaattaaggacaacggcaaagggatagaagaagaggagctggaaaaagtgtttgatcgctattacagggggacaaatacaggaacgacgcatgcaggctctggtcttggaatggccatagcaaaggatattatccaaaagcacggaggggacatcaccattcacagcaccgcgggagaagggacaacgatagatatacaattatcataatggctatacaaaaaaaacggttctgctgattaataacagaaccgttttttcctattgttccgaaaacactttgattcctttgacaatgttccaaatgaaaaaatagatcgccacaaggaatgtaacagcataagtcgcaagcaggaaaggcccggcatgtctgatatcattcataccaagtaaacctgaagcgatgatgccaattccaaaaatcaaataaggaatcagatgcgtccacaaagattttttcgcatgttctttcacatcgtcccggcttaagaaatagacgataatcggaaacagaaacggcgcaaaaaatatactgaagtaacataatgaagacaaaattttattttctctcaaaccttttcacctctatgatttattgaagggggaattcttctggctgaatcccacactgaagtacaatcttattgtacaactccaaccttaacccgtattaatccgaaccttacatcaaccttaaattaacaaggacgggcaagggctcgtcttcttacagcaatcataagattcaatgccatattgagactcatcacattacatttagagcgtctacgtcggaaatacatttaatttttcgattcgattgaaaaataacgtgtaaagtcccgattcagtccagttttctttgttctatatgtgtcaggtgtgtcttattcaatagagttagagcaaattgacaggcttttaaacctcccaaaaacaagaaattaggttgatagacaatcatgagaaagatttttacaatgagttcgagctcataagaagtgaagagccaaaataatgcgaaggaggaaaagatcagatatgaaacggtcaatttctatttttattacgtgtttattgattacagtattgacaatgggcggcttgcaggcttcccaggcatctgcagcagggacaaaaacgccagcagccaagaatgggcagcttagcataaaaggaacacagctcgtaaaccgggacggcaaagcggtacaattgaaagggatcagttcacatggattgcaatggtatggcgattttgtcaataaagacagcttaaaatggctgagagacgattggggcataaccgttttccgcgcggcgatgtatacggcagatggcggttatattgataatccgtccgtgaaaaataaagtaaaagaagcggttgaagcggcaaaagaacttgggatatatgtcatcattgactggcatatcttaaatgacggcaacccaaaccaacataaagagaaggcaaaagaattttttaaggaaatgtcaagtctttacggaaacacgccaaacgtcatttatgaaattgcaaacgaaccaaacggtgatgtgaactggaagcgtgatattaaaccgtatgcggaagaagtgatttccgttatccgcaaaaatgatccagacaacatcatcattgtcggaaccggtacatggagccaagatgtgaatgatgcagccgatgatcagctaaaagatgcaaacgtcatgtacgcgcttcatttttatgccggcacacacggccaatctttacgggataaagcaaactatgcactcagtaaaggagcgcctattttcgtgacggaatggggaacaagcgacgcgtctggaaatggcggtgtattccttgaccagtcgcgggaatggctgaattatctcgacagcaagaacatcagctgggtgaactggaatctttctgataagcaggaatcatcctcagcgttaaagccgggagcatctaaaacaggcggctggccgcttacagatttaactgcttcaggaacattcgtaagagaaaacattctcggcaacaaagattcaacgaaagaacgccctgaaacgccagcacaagataaccccgcacaggaaaacggcatttctgtacaatacaaagcaggggatggggtgtgaacagcaaccaaatccgcccgcagcttcacataaaaaataacggcaatgcgacggttgatttaaaagatgtcactgcccgttactggtataacgcgaaaaacaagggccaaaactttgactgtgactacgcgcagattggatgcggcaatctgacccacaaatttgtgacgctgcataaacctaagcaaggtgcagatacctatctggaactgggttttaaaacaggaacgctgtcaccgggagcaagcacagggaatattcagcttcgtcttcacaatgatgactggagtaattatgcacaaagcgacgattattcctttttccaatcaaatacatttaaaacaacgaaaaaaatcacattatatcatcaaggaaaactgatttggggaacagaacccaattagttaagctttaggcggacatcagcaacgatgtccgcttttatcatcttaaacagcaatacatggaggtttacgtgaagaagtagatatgactgtacatataatgtaatcgtttcacagttttgaaaagcgtttatagcgcaatgtatgtattttacacccgccacttttattacttaagggggaacaagagaatgaaaaggtatgacgcatttccagagccaaccggcggctatactgtcggccgcacacaactggattttgagtacacggcatcagatcatacaaaaagagaactgacggtgtttgtgtactatccgtccgacagcagcgaagggaagactacatcaacgtacatgtttcctgaagtctgcgaaatgcttgatgagcagccgcttctcactgcgcggaagaatgcttactctatagatatcaagacccaatgttacgacggccttgctctctccgggaaggaaaaacgctatccggtgttattctatgtttgcggcgggggcggttctccagaatggggcacagtgatctgtacagacttggcaagcgtgggatatgtggtggtaagcatcggccatcagaatagcacgatgtataagcgtaaagatgggcgcccgtttaatgtatcaaaggattttacgtagaggttttttaatattaccttacaaaaaggggatgctgttagaatatggacccacttatatattctcttcacaatttctagtttacataatatatattctaggaagttatacagagaaatgaattacaagtctcataaaccaagtatactttagttattgagacaaagaagagaaatttataactgcaataaatgtttacagcgctagttttgattcagctgaaaaacctaacgcaaaagcaagcttgaaatgaatttcttgtttggtcattacccgcaatgagatcatttctttaggcaagcatataaaaaatcaggtctgataatactttgccgcatcttccctgcttttttccgcgtaatcataaacaaaaagaacaagattttcagcagggccatctgcccggctgccttcatcataccgctcaatgtaggaatctttgcagccgttttcatttcacgaatcgtgagagacaggcaaagaccgcaagaccgaggccgctcccggtccaaaacgacaaaaaactttctccataagataaacgtgacaatgagaaaaagcaccttgtctttcgtaacgcatcacatcctctaatatgaattgacttccgggtgcattatcttcttcctatctattcatataatgagaaaaagccgcctgataaacagacggctctgcagcttattatttgcttcggttacctgcggaagcatgagtgatccgataatgcacagttaaaaatttcagtccgaacagccacatatgatgaacggccttcaggcttgtttcgctctgggctgaaataagaaatgtctctgccagcggaagatgacacgtcccccatttcgtctggagataaatcccttcatcacccgctccgctttttcgccgtctgcttgtcaaaacaagattctgcttacgcgcataaggctttaaaatgcccgtcatttggccgtacggcagaggaagagagatattcatgtatccttccccttttgacctgtatgctgaatacagcgcagtaaaaacggtttcctgcttttcatttgttctgatccatgcacggacattttttctgccgtctttatcagagtcaactcctataatatcactgtgcatgatataccaatccggattcatggacagatgaatctgtcccgctcttctgctgaacggctcgtacacgcgcgcgaacggacgaaaccaaccgctccacgtcactttcgccatgatgtcataatcaattgtcttttcataaaaggaaataacggccggcgccagcttttcagttgaaaagtcttcagaatgcagttctctcagctgatcctgaaggccggtataatggatgtcatttgctgcatgaatgtcagtcaaaaaatctttgcctatcgttcccttcccgtaaattctgctgaacgttctttcactgttctcatcgaacggtctaggattttctattctccaccccgccaaagccggcaggataacgccaaatgcattgacggccccgtgaatccaaatcatctggctgatcgtgagcgttgcctcctcgcggtagacaccgtacgaatatatcaaagaaaaagcaattgtgatcattaacacagccgaagaactcctgatcaagatcctgcctgttttcgtaacaaacggcgccttaaagacgagatatgcatttacatacagacccgcaagatacagagcgacagcaatcacatcaagtgtctttgaaaatgtaatccccaaggcaattaggaccggcgaaatcaaaataatgactgtgctccaccggtaaagtccgcgtttctcccgtatgatcctgccgagcaatccgttaaagatcggaatgagaaaagcggaatagtgaaagtgcaccgccgtcagcagaacgataagcgggccgaaattcaggacgggaatctcaaggacatatgcgaagaaccagaatccgcccccggccaaataaatgaaacccgccataactgacatctcttctgttctgtgaatatttgttttcatcagccggcggacagcatacagtgccagtccaagcgtataaatgaaccacacaaaggcaaaaaagctgaagcctgtgacaagcgcaagcgccgcacatatagcggcaacaggataactccgtaaccacacattctctaaggtctttgacggccgaaaagcaaagcagaatacagcgggaacgaaaaaaagcacggaaaataaaacaaacgtctcagcagctgatatatgcggagcttcagccgccgcaaatcccaaaaagcaaaccacgcttaccatgagatgacgcttcagcatgtttctccctctgtttcccggaaagtcccccggtaagagaaaagcgtgccgagtatccggtttttcacatgaacctttatgctgaagcaattcatttcctcatcataagcctcataaacggttgaattcccgcacagccatgccggaatcgggattttctttccgcctatcaggagccactgccttccggatgtaataacaagccctccgtctgaagacgcttctaaatgcagttcagacagtaggatgtgaggtttgccgaagtaatcaagaattctgttttcccgctcatcatattccatgaccgcatcaaaaaaacgcgttttgcctttaaagaaaaaggtacgattccattccacgccattttgcctgtttttgttttcgatagtaaaagggatatcgtttcccctctctgagaaaaaacatctgaaaaaaacaccggtctttaaaagcattctgacaagaaaagaacctccctttatttctgacataacgccttctccgcaaaacgtgcgtgatccgtcaaatctgtaccgtttctgcagcatcgggtgcagtgattgataatgagtaatcgttttttcatacattgaatccgtcatttcacttctctctttcgttttgtatgccaggcgctcggcagcttgagcttaagaatcatgccggctatcgtaaggactcctaatgaaatcaagaatccgccgccggaatataacagtgccgttacacaaaagaagactgactgcccggcgtgaatcagccactttctccgcatgggaagcagccataatacccctaaccctgtctccagcgttcccctcacgatctctgcatcggcacagccatcatgaaagccttgaaaaaaccaatacagactgaatacgaggcacatacagacatagacaaatccgaaacggaccgatatcttcggatgtctgttttgttctatccaaagccgcaacgcatcaaagctccatgcggtagcccagcttagcagaggacgaaataaaaaccggtctatccaacttcccggcagaccgcgggccgtttcatattgatattgagtcaaaaatgaggtttgtccgttatcccgctctgtatacttccagtagcccctgccttcttttataagtgacagcggatgatcagaggcaaaagcgagcgaagacactctttctgacaagcgaggccttatgtcacctattgattcgcccgtgccggataccttcagcccaaaaccgattcgtgtttcatatagaaatctctgcggttcatctggcagcctatgaagatatgtaatgtcagaaaaacgcagatcccattctttatgaagatgcgggttttgcgtatattcccaaagcgtttctatatcagatgcaatattgatttcgacatatatcggcttctgtttcatgctccctcctcttcccttcttttgtaaacaattcctatattatcataggaacagatcaagcgggagaacgaaaaggccatcccgttatcggcaggacagcctcagtggctttgatgacttatgaataaggtatcgtgtcttttttatcttcagaaactgtttgaatgataatcggacgcacaaaacggattaccgcagccgaggccaaaacagctaatccgcctgcaagcaaaaacgcccccgagaatgatccgcttttatccgcgataaagccggttaaagcaggcccgataataccggccgtgtttgcaagaaaatgcataaagccgccgactgacccgacattcctttgatcaaccacatcgtgaatcaccgcccaatagatagagcccgttatatataaaaagaagactgataaagcaacgagaataacggcacttacggcagtggtaacaagtccggcaaatccgatcagtacagcggaagcgaacaggcaagtgacaagaatgactttccgtgagaacaaaaccccttttccggcggtttttttgtatacataatcagaaatcattccgcctgccgccaaaccgataaatccaagaatccagggaataacagtcaccacgctcataaattcaatacttaatccgcgttctttcaccagatagctcggaaaccatgttaagaagaaaaataagatgtaattgtaggcgaaaaaggcaaaagccgtgaagagaaccgttttttgttttaaataaaaggtcatcgggatatgctgctcatgcgattgaaccgccgctttcattgccggggtgtcttccgtctgtgccggccgttctttgacaaatttaaaccagataaacgcccagactaaaccgacgatcatgatcaggacaaaggaaaccttccagctgaatgccacagcaatcatcccgacaatcgggccggaaatcgctccgccgagcggcgtgccgctgtttgtcaggccgatgaccgtggcgcgctgagacggaggaaaccaattgttgaccattttgcttatggcagccgacagcggcccctcgcccataccgaataaaacacggataatcaaaagacttacaaatccgaaagcaagcgcaaccgccccgctgaaaagagaccaaacgatcatcgccgtacacaatgtcaatttagccccgtaccggtcagatgcaacaccgccaaggaagttacacacagcgtatccgacagaaaaactgctgaaaatcagccccatttgggttgcagacaatgtgagatcctgctgtatgaacggcgccgcaatagacagcgctgaacggtctaaatagttaatcaccccggctgaaaataaaagaagaagaatagggaatctatcctttgagaacataaaatccctccctcttatttcataatttaaattgccggagtaaaccggtttatgtaatgaaaccggttatccggattgccttgccagaagcgccggtttatagcggtgaatccgtttttcaccgctatctttttcttgtatctggcaaagaagaaggcttcccgcttttcgcgccatttctgccgcaggctggacgatcgtcgtaatcggaggagtaaaaaaacccgcaaaaggaacttcatcaattccgatgacggctgccttatccgggattgtcatatcatgctccttcatatacttcagcacctcaacaagaacgatatcgtttgccgccaatatcgctttcggaggctcctgaagtgagaacagctctgacaaaacattggaaatatcagccgcatcggctgttttgatatattcgttccgcaccatcatcccgtgggggtcaagcgcctttttatacccttcaatccgctctaccctcggactgatttcccgaataatggacgtcgtaataatcgcgattctcttaatgccgctctcgataaaccggtcaacggcaagaccggctgcatgatggttatcaagcatcactgtcggaatcccgagttcttcaatggttctgtccataaacacgaccggaaacgtatcgcgtttcatcttttcatataaggagagattttcgcccgtcggaaaaataataattccgtccacctgcttggccctgagcatttcaatatatttcttttctttttccggttcatcatccgcattgcagacaataatatgaaatccttgttcatgaaaatagtcttccaccgccctgatgacctgagtggaaaaggtgtgaagaatattagccaccaccacacctaccgtaaatgttgatttctgttttaagctgcgggcgacgaaattcggctgatagttcagctcatgaatggccgcttctattttttgtttcgttttctcgctcatatagtcatagcgctgatttaaaaattgagatacggtgcttttagatacgtttgcatatttcgccacatcagaaattgtaatggttttcatagactcatccccgtctgtcttcatttttcactagtataagtcagaagtaaatagtttacaatctgacagggaactggattctgtcacactcccgaataagccataaaacctccgtcgacgggaacggtgaccccggtgataaagcctgagtatgaatcatccgaaagccacaggagcgttcccagaaggtcttccggtttcccgaaacgtttcatcggtgtatgtgccataatcttattggatcggtctgtcagacttccatcttcctgtaataacaactcacggttttgcgcagtcaaaaagaaacccggagcgatggcattcacccgcagcccttttttcgcgaaatgaacagccatccacatcgtaaaattctgaaccgccgccttagccgcactgtaggcaggcacctttgtcatcggtgtatacgcactcatagaagaaatattaataatcgcgggacattccgccttcaaaaggtcttttccaaacacttgcgatgccagaaatgcaccggtaaagttgcttgaaaatacgctggaaaatcccgtttcgtccatatcaaaaaatgatgggctctgctcatcctcttcatacgtctcattggcagtgatcgcatcagcgtggtttcccccggctccgttaattaaaagattgacagagccgaaccggctgataatctcgtcttttgccttttcgagcgaatcacgggctgaaacatcagccggtacagaaaccgcggttcctccagcatcagcaatctcgcccgccgcacgctctgctttatcagcattccggctgacgatcgcaattttcatcccctgccgtgaaagctcctttgccattgctgaacagagaacaccgctcccgcctgttatgacagcggttcttcctgataaacgtccatgaatcggtctcatctcttcacctctttctcatgagacgagaacgcatcccacagtccgctcaagtacataattcctaaggcacgatcatataaaccatagcccggccggcattgttcgccccagatatgacggccgtgatcaggccgtacatatcctttgtagccttggccgtgcaattcttttaccacaccgataatatcaatggacccatcactggtaagatgcgaagtttccgtaaaatcaccgttatcgcagattttcacatttcgtatatgggcaaacggcgcagctcccgcatagtgtttggcgatcttcaccatatcattggcgggatccgctcccatcgaacccgtgcacaacgtaatacagttggcgggtgaatctgaaatctctcgcagcttttcataacttttctcaccggtgataatacggggcaggccaaaaattgaccaaggcggatcatccggatgaatggccatttgaatgccgtgttcctccgctacaggaaggatttcatgtaaaaagaattctagattggcccaaagctgtttttcaccgaccgtttgataggcttcaaacagttccttgatccgggccattttctccggctcccacccgggaagcgtcaaatcagaagattcttcaaccgtgcggatcagttcttctggagggagactttccactttcgctttttcaaaaaacaaagcagttgacccatcctccagtgcgcggaacatatcagtacgcgtccagtcaaaaatcggcatgaaattgtaacagatgactttcacgccgaattcggacagattgcgaatggtctgtttatagtgctcaatatattgtccgcgttcttcatggccgagtttaatggcttcatgaacattcacgctttccacgacctctgcatgaaacccataggattgaatgaatctgacttcggcttcaatgtcctccttttcccatacttcgcccgcgggcttctggtgaagagcccagacgatgcctttgaccccgggaatttgtctgacatgttcaagcgtcaccgtatcattaccttggccgtaccagcgaaacgtgatattcatgttacacccccgtatattcgttttttcggcagacgtattctttgctgagggatacggcagcttcatagccgcccttttgatatgcttttgtcaagtcgcttcccactccgaccgcgaccgctccggcagaaagccagtcattcatgctgtttaatgagatacccccggtcggcataatgcggacattcggcagagggccgttgaccgacttgataaatgagggattaaacgaattagcggggaacagctttaccacatcacatccggcttcgagcgccaaagccatatcagacacgctcatgcatcccggaagatacggtacgctgtactggttgcatagagatgctatctcttttacaaaatgagagctgacgataaatgaggcgcctgataaaatggcgtgtctcgctgtttcggtatccattacagaaccggctccaagaagaatatcttgatgccggagttccttaaagacatcttccacttcaggagttgtgtatgtaagctcaatggcgctgatacctcctgaaatggccgcttttgaaacttcaagcgcctcttggctgttttgtccccttatgacagccaccacttgtgcatgcagaagtttttcgtaaatggcgtacttaggcagcattctcgctcctcctttaatcaaacgtaatgattgcttttcccaccttgcccgggtgctgttcgatcaactgaaatgctcgatggacgtcatctgctgaaaatgtatgtgtaataagaccgccgtgcgttaacaggcctttattcagtaagtctgtaatgtacggaaactgattcgtctgcaatcttgaaccggtgatcgtgacttccttttttgtgatcggaagctgagaaatgccggcagtcctctcatcaaaaccaagcacaaccacatgaccggccggagacactgcgtcaattgacgtttcaaacgttgaggggagacagacggcatcaatgacgacattagcgccttcattttttgtccattcgttcacccgcaaaacgggatcttctttttgcgcgttgacggtaacatccgcaccgtttttttcagcgaaggccaagcgttcatcattcaagtcggttatcatgacggaagcgcctttgaactttgccatttttaatatgcagattccgatcggccccgctccttgaatcaaaacggtatcttccttctcgacacggcctctccaaacggcctgggcgccgatcgtatatggttctgccatgaccgcttcctcccagggtagatcgggcgaaacagcatacagctgcttttccggaagcacgatatattcccgcatcccgccatcttcatgaacgccgaacaccgaaagcgctttgcagacgttcggacgtcctttccggcaggcatagcatgttccgcaataagatatcggttcaatcactacccggtcacccggcttgaaacgccggacatgagaaccggtctttgcgacttcccctgtgacttcatgtccgattactctcggcagggacgctaacggatttgtcccatgataaatatgcaaatctgatccgcaaattccgacccgattcaccttgacaagaacatcatccgcgtggacaacagacggtttctcacattccgtcaccatcagatcaaatgctttccgtacttgaaccgctttcattttttcacccgctttttaagttgtgcttgctaccgttcaatcacagtctctttgtttacaaatgacagaacctcttctaggcagggaagcccttcattgtcaccggaaactgtggtgacgagcgcaccgactgcatttgcaaactccagacgtttttccggttcaaaaccatgtagataactgtacaggtagccggcattaaagccgtcacccgctcctaccgtgtcgacaggcgcaaccgggaaagcctctttgtgaacccacttatgatcatgatacagcgcagaacccgcttcaccgtcttttatgacaagctgactgattgaatagctctctgcaaaccgggctaatgcttcattttctcctatacctgtcagctgtttcatttcgtcccggcccgccagaagaatatcagtatgcggaaagatttgatgaaatgccgcacgtgcctcctcaatcgtccacagcttcagcctgatattcggatcaaaagatacgggaatctttcttgctttggcgatggaaagcaccctttcagcaatttcaagatttttcttaccaagcgcgaggaacacaccggtaagatgaacgatgtgaatgccgtcaaacatattctcagttatatcttccggtgcaagagtcagaattggtgaattgaaacgataataaaacgtcttgcctgaaccgtcatttctgatctctttgacatttaaagatgtaggaaagccttcaacaaaggagacgtcagtcacatcaattccttctcctttggcaaactgataaatcactctgccgaactcatccttccccagtctgctgacccactttgagtgcaggttcaatctggcgcatgcaatcgcaaaattcagttcagctcctcctgcttttcgttcaaaatgggtaacaaaacgcaaaggtcctgtgcttgcgggatttaaggtgatcatcgcatcaccgatcgtaaaaatgccataatcagaagccacatcaatactcctttcctttaagactaaatcggtttggtaaaccggtttagttaaactttatatgaaagcacttacatatacaagagaaaaatacaataaattcaaaaaaatctgtttccagtaaaaataacccggtttttcacataaaaaacccctcacaacaaaatgtaagggggttttttgaaaattgtatgcatgtttcctcagttagcagtcttacgttcagggcttgtaccttcttcttccgcccatgtttcaatatgcttgagctccggagtattctcggctttgaatacgggatcaagaccttttttgcgctgagcggcataatccttatagatcttgtaggctacattactcagcagtaaaattgccactaagttaatgagagccaagagacccataaacaagtttgccatgtcccagacgatctggaagtcagccaaacatccgtataccaccatcactacgacgaatacgcggtaaatattaagccatgttttgcttgttttaataaattcaatattcgtttcaccatagtaatagttgccgacgactgagctgaatgcgaataaaaacatcgcaatcgcaataaatgtcggcgcccatccgccgagatggtgctgcagtgcggcttgcgtcacttggatgccgtcgcctttaggcgtaacgctgtacaataaaatgataaaagcagtcgatgtacaaacgataaacgtatcaaagaacacgccgagggtctgaattaatccctgcttagccggatgcgacacatgtgcagctgctgcggcattcggcgcgcttcccattcccgcttcgtttgaaaacaggccgcgctgcgctccgataataatgatgcttcctaagcttccgccgacgatctgctcaagaccgaacgcatttttcacaatcgtaacaagcagctcaggtaccgccgaaatatttacaatcacgacatacagcgcgatcagaatatacattcccgccataaccggaacgattaattgcgagacggaaacaacacgcttcagaccgccgaatataatgaaagccgttaatacagctaaaatgattgcgataactgttttattcacatggaatgcttcgtcaaacgccacagaaatcgtatttgactgcaccgcgttaaatataagtccgaaagaaacggtaatcaatacggcgaataaaataccgagccagcgggcgcccagtccctttgccatgtaatatgccggaccgccgcggaattcgtcaccggaacgcactttatacagctgtgccaaggtgctttccacaaagctggaagccataccgacaatcgctacgatccacatccaaaatactgcgccgggaccgcctgttgcaatcgccagcgcgacgccggtcaagtttccggttccgacacgagaagctgctgagataaagaatgcctgcattgaagacactcctttatttccttgcggcttctccccgacgattctgaacatttcaaaaaagtactggaattgaataaagcgaaaacggaacgtaaagtacaatccgatcccgactaaaatataaacaagatacttccaaataaaatcatttggaacatttatgatttcactgatgaaagcctccatgtttaacctcccttttacatatcttttactgtcatttttgctgtatatgttagatcttttaacacaacgggtattattatatcacaacaacagtggttgagaagtttttttaagaaaatgtttcggtttcttcatcacatcttttgctgtcatgccccgttttttatcttacagcctgaaaaatgttgtcacgttataaggaatgcgtgcatatcataacaaataggtctttaagaaaaaagagatgaaaagatggatggaatggtatatacttaaccaggataataattttttaaatttaataaatgtgtttactttacatttaaattagggtattataataaaaatattcagacttatgaagggaggagaacatttgaaaaaaatcttgtttttaaaagcttctattttatttttagcgattgcaagctttcatttgctctccattccccatgcgtttgataccgctcatcattttaaagcggtagccgaccagcaggaaatgcacgaaatgaaggccggccaaaatgctgatgatgagaaaaaatcgctgacgggctcatatatcttgacggcgctttttgccgcttctgtctcactgattgtgatatcagacaggagacgccccgcttcccggagaagacagcgaaagaaaagctttttaatcgctaaattttatcagtcctcgtatttcgatgagcttcatgttcaacatcgcctatctatgtaacataaaatgaggaggttgttaaacatgttgtttatcttacgaatggtgattttagggttgttttcattcactgcattgaatttatttgtatggcagggaatcgaagtcattcacgctatcactgacttattcggcagccatgaaagctaaatagtaaaacctccgctcaatgagcggaggttttttattttatttttactcttaaacatcgtatgcagggatacgccatacatctgttaccggccctgtctcatcttcatcggtaaagaaggagccgttgctgtatcggtcattcgcccgcaaggacttcacggcgatttcgattctctcgcctttttctgtttccgcagcgatcatgtcggccaaagcgcacgcaaatacgccgactgcccgatgcgggttcttttttagctcacgcagcatgatgacaccgcgtttcgccctggatgttttttcgaattcagataggttcatccgtttgattgctccccgctgtgtgacgaggacaagcgaatctgtttcatgcaggatttgccctgatacgacggtatcaccgtcttttaaatttatgccctttacgccggccgcacgggcaccgactacatttacttcatcttcaccgaaccataaaccgtacccgaggcgggtggcgataaacagctggctgccgccgtctgtgacatgaacatcaatcagctcatcatcccctttaaggttaagggcaacaagcgctttcgagtaacgctgcgctttgtaatgcgtcatttcagttctcttcaccataccgtttttcgtcatgaacagtaaatatgaagatggatcaaattcttttaccggtatagctttcacgatggtttcatcacggtcaatcgtgatgatgttcgttacgtgctgccccatgtctttccacctgatatcgggaagctggtgaaccggacaataaacatagcttcccttattggtaaagagcagaagaacatccgttgtattcatttcaaattggtgaatcagcctgtcagtatccttcataccgaaatcctggccgttagaagcggcaaatgaccgctggcttgttcgttttacatagccgtcttttgtgactgtcacatatacgtcctcagaggcaaccatgacttcaagattgattttaatttcctctatcttttcttcaatgacagaccgtctgctgtcagcataggtctttttcaattttttcaggctgcttgtaatgacttttaacagctttttatcatgacttaaaatggcttcgagctcctgaattttcttgctgagctcttccgcttcctcttttagcgccgtaatatccgtgtttgtcagacgatacagctgcaaggatacgatcgcttcggcctgcggctccgtaaatgcgaatttagaaattaagttttgtttcgcatctttcttgtcgctgcttgcccggatgaccgctatgacctcatctaacacggacagtgccttcatcagtccttcaacgatgtgatgccgctcttttgctttttgtaattcaaagacggagcggtttgtcaccacttccttctgatgggaaatatacgcatccaggatggccgtaagactcatcagcatcggccggcggttatgtatggcgaccatattaaagttatatgttgtctgcagatcagtgtttttatataagaaattcaggatgccttttgcatcggcttctttctttaactcaacgaccacccgaagccccgtgcggtcagtttcatccctgacttcagaaatgccttcgacttttttgtctatgcggtattcgtccattttcttaacgagattggctttgtttacttcaaacggaatttctgtaatgacgatctgctcccgtccgcctcttacggattccacttcagccttgccgcggataataattttgcctttaccggtttcataagccttccgaatgccgtcgactccttgaataatgcctcctgtcggaaagtcaggccctttaatcacctgcatcaagtcatcgacagtgcaatccggagattcaatccgtttaatgacggcatcaatgacctcacccagatgatgagggggaatatcagtcgcatagcccgctgaaatcccggttgatccgttaacaagcaagttagggaacatggcgggcaaaacaaccggctctttactggtgtcatcaaagttcggaacgaattcaaccgtatttttatcaatatcacgcaaaagctctgacgcgatagaagataatctcgcttccgtataacgcatggcagccggcggatcaccgtcaatgcttccgttattgccgtgcatctcaatcagcacattccgcactttccaatcctggctcatccgcaccatcgcttcataaacggagctgtcaccgtgcggatgataattaccgataacgtttccgaccgtttttgccgctttacggaaatttttatcgaatgtatttccgtctgcgtgcatggcgtataaaattctccgctgcaccggctttaaaccgtcacgagcgtcgggcagcgccctgtcttgaataatgtatttactgtagcgtccgaaacggtcgccgattacttcttctaacggtaaatcatgaaataattctggctgtgccactattaaacctcctcagcgaccgacaagttttcattttccaaaatattgctttcctcatctaatccgaaggcaacattcttttcaatccattttcttctcggttctactttgtctcccattaatgtcgttacacggcgctctacccgtgccgcatcgtcgatcttgactctgacgagcgttcgcgattcgggattcatcgtcgtttcccagagctggtctgcgttcatttctcccagacctttatagcgctggatggtatatcctttgccgactttctttaaaacgccgtccatttcttcgtcggaccaagcatattcaataatctctttcttgccgcttcctttgctcactttgtaaagaggcggaagggcgatgaaaacttttccgtgctcgattaaaggtttcatatagcggtagaaaaacgttaacagcaagacttgaatgtgcgcgccgtcggtatccgcgtccgtcatgatgatgatcttgtcatagttgatgtcctctatatcaaaatctgcgccgacaccgccgccgatcgcatgaataatcgtattgatttcttcatttttgaagatgtctgcaagctttgctttctctgtgttgatgacctttccgcgaaggggcagcacggcttggaatttccggtctcttccctgttttgcagagcctccagcagagtctccctccaccagatacaattcattcttcgccggatttctggaaccggccggtgtgagttttccgctcagcgtcgcttctgattttttgcgctttttgccgcttctcgcttcttctctcgctttacgggccgcttcacgggcctggcttgctttaatcgcttttttgacaagcagggttgccgtatcgcggttttcttccaagaaataagcaagattctcagaaatgacggcatccgcggcggatctcgcctcacttgtgccgagcttccctttcgtctggccttcaaattgcagcagttcctccgggatacggacggaaatgattgcggacaaaccttccctgatatcggcgccttcaaggttcttgtctttctcttttaaaagggcgacctttcgcgcatactcgttaaacgctcttgtcattgccgttttggctcctgattcgtgggtgccgccgtcctttgttctgacgttattaacgaatgacagcatattttctgaatacccgtcattaaactgaaacgcgaaatcgacttcaatgtcatgatgctcgccttcaaaggacaccacttcgcataaagcgtctttttcctcgtttaaataagcgacaaatgcttcaattccgttctcataataaaatacttcttttacgcctttccgttcatcaattaattctattttcaaaccttttaacaagaaagccgattcgcgcagacgttctgacagcgtgtcaaaattataaaccgttgagctgaacattgacggatcaggtttaaaatgggtaagcgttcccgtttttttggtcgttccgattttttcaagtgaagtcacgggcttgccgccgttttcaaaccgctgtttatagacatatccgtcacgctcaatagtaactgtcagccactccgataatgcgtttacgacagatgcgccgacaccatgcagaccgccgcttgttttatagccgccctgtccgaatttccccccggcatgcagcacggtgaaaataacttccggcgtcggctttccgagcttatgcatcccggtcggcattccgcgtcctctatcctgaacggagatgctgttgtccttatgtatcgttacgataatatgatctccgtagccggcaagaacttcatcgacggaattgtcgacgatctcatataccagatggtgcaggccgcgtgcgtccgtcgaaccgatgtacattcccggtcgttttctgacggcttccaggccttcaagcacctgtatggcatcttcgttgtaatcaaattgctgttttctagccaaacgtacaaacccctttcaaaaaacctgctcttaatcattctcttttttaaatgttttcatgtctttgtttttcagtatgcgcaagcttcggtccaattctcctcggactcacaattataaccaatatgcttgatttcgcaacatatttaagcgaatggctcgttttttaggccgcaagacatacattcgaacggcttttcatctttttggtgcccttttcggcagataagaacatgagttcgctttctattatatagctttatgccggccatcgcaaacagactgcaaacccctgtataaaggggtttctaaaaaagctgttcatgctttattgtatctgtttcatcatcatacgcaaagagtattctttcaataaaaaagcaaaaacccctgatttgccaaggatttttgccttttttgttcctattttataacagcgcgggcgacttttatacataaatccattacagccgtccgtcctttgtctgtaatcatgcgatacgcttcttcatttgcaaggccctgctgcgcccaaaaaacgggagcgtccgtctgtaaaaattcttcagcaacgccgggaagctgctcagagcgtctgaacacattcacgatatcaatcggtccctccacgtcttttaatgaagcaacggctttaacgccaagcgcctcatcaatcgttgggttgacgggaataatttcatacccttcatcctgcatcgctttggaaaccatgtaagaagtccggtcgggacgatctgacagcccgacgaccgcgatccgtttgctccggtccagaatttctttaatctctgattttgaaggattttgcatctttaccatctccttttgatatattgtacatgaccgcttcgccggaatcaaaaaaagcgatttgtcagcttaattctcaaaaaacttgtcatcagacggtaacaactcgtgttaaaatagagtgaagggacattgaaaaggagaaatgtagatgttgattgctttattgattattttggcctatgcaataggcagcatcccgtcaggtttagtcgtaggcaaacttgcgaaagggatcgatattagagaacacggaagcggcaatttgggcgctacaaatgcttttcgcacgcttggcgttaaagcgggatctgtcgtcgtcgcagccgatattttaaaaggcaccctggccgcggcgctcccatatttactgcacgtccccattcatcctcttctcgcaggggtggcagcagtgatcggccatgtattccccgtgttcgcaaagtttaagggaggcaaagccgtagccacatcagggggcgtcctgctgttttatgctccgctgttattcgttacgatggttgcagtatttttcgtatttttattccttacgaaatttgtttctctgtcttcaatgttaacagggatttatacgattatttactgtctgtttgtaaaagacccttatttattaatcgtagtgacgctcttgaccgcgtttgttatctacagacacagggcaaacatcaaacggattataaacaaaacagaaccgaagatcaaatggttttgatgaaacttcaattttgacatcaaaatgccatatgcgtttataatagagataatttctttatatgagaaacaaaaagggagtgttccggatgaacatgaaagtaacgaaaggcgcgctggattggtacaaagaagagctcgatctggaaacaggcgaccatgtccgtttctttgtccgttacgggggatgcagcaacgttcagaaaggcttttctctcggcattttaaaagacctgccgatgaacatcggcaccagcacggaagttgaaggcattaccttttttattgaagaaagcgacttatggtactttgataatcacgatttgtcagtcacatattcagatcaggcagaagagccggtatttgattacgtgtaaaaaaaagaacgcagcggatgcgttcttttttttacagcctgaacctttttaggtgatcagtcagacgttctttttctaatatgcttctttgcgtttctccgagcaggtcaaagtggggaaattcatttttatggtgaatccactccggcttcagcccgtactccgctccccatctgatcagtttattgagatcgcttgaaccggccttcgtcacggtcttagcctccggaaagcggtcgtccagccagtaatgcgttaaaaaagcgattttcccttccgatacatcctgcttccatctttccagttccttacgcgtaattccaaatgccataagtgcagccgctccttatttttttgccttttcgtaagcggcatgccaatcaggaaaagccttgcgaaactgaatcggtttgaagctctctttatcaacgcatatatgagaggatgtcgctttgatggcaagttcttgatccggattatagatgtggtagccgtaaacggttttaaatccgttatattcttcaatccaagtatgtacgacagccgtttcaccgtagcggagcggctttttataagaaatgctgatatccaatacaggggacagcactcctctatcttccatatccttgtaaaggaatccgagttccttaatcagcgccgttctgccgacctccatccagactaagtaattggcatgatagacgatgcccatttgatctgtttccgcataacgcacttctatttctttttttgacacatgcaacgttctctgctccctttttatcagattagccccattttatcacaacgagccggaaagagaaaaaaaccaggtttccctggtttttattatgattgatagccgttttctcttgcagccgattcatcctgaatttcactgcggaacgattcaatgctttcattgcgtctggcattcttttcttgaatgcgctgtttttcctcatctgtcgcaaattccattgattctttcgcttcttctatattttcaattgtattctgcaccatatcctgcagcttttcaacgttatcggaacggtcatccggattcggtttttgatcattgtttgtcataatgtctgctctcctttgatgatgttattcgcctttcgtctgcatgacaatcggatgtccgtttgacttgtcatgaaacttttcccctttgttgcgtttatatttaacgggttttgtccctaagtggctcggagcgtattgcggctggccgtctttcttgtttatgcccatgttcatccctccttaagagtatattttgcaaaaggaggtgcaaacatgactgcaaattaaaggttatttttgtttgaaccgctgctccagcttttcttcaagctgattcaaatattccgtattggtcatcagctcacgtttattttccataaccaattcatgaaaagaacgttttcgcatttttttcaatcttctcacctccgtgttttcattcattttttccaatttttcaaaacctaagcccttcacaataaaaaaactgaacctctatttgagatccagtttttctttcatttctttttttgtcatcgtgcctacgcgaatgtgctgaatggttcctttttcgtctaatatgtatgttgtcggataagaaagcacgttgaaatccccgttaattccgcttttgtcaatcagaataggaaaggtcagctgataatgatcagcaaatgatttcacagcctgtatatttttttcagaagacgtaaaattaacggctgctaccgcaatatcaggatattctttctgcagctcctgcatatccggcatttccattcggcacggcttgcaccacgtcgcccagaaattgaggagcactttttttcctttataatcagatagggagatactttttcctgacaatgtatcaagtgtaaagtcaggggctttcatcccttcttctgtcccttctttcggacttttttgcacggaataaatgttccagcccgcatatactaacaacccgataagtaacattccgcccagccatttcgcaagcatcttaagcctcccgcataaaaagagagaaagcagactgctttctctcttttgttcattctgctactgtttcattttatcgcgaagcaccatttgtaaaatgccgccgtggcgatagtaatcaatttccacttcactgtcaaaacggacaacgacttcaaacgtttttaccgtaccgtcttcactgattgctctgacagtcagcaagtcgcgcggacgtacagattcatcaacatccacctcgatgacttccttaccggttaagccgagtgtatccgcgttttcgccctgtttgaactggagcggcagcacacccatgaagacgaggttgcttctgtgaattctttcaaagctttcggcaatgactgttctgatgccgagcaggtttgttccttttgcagcccagtcacgtgaagagcccattccgtaatcttttccggccaggacgacaagacccgttttatcttctttataccgcatgcaggcatcataaatagatgtcacttccccggtaggccaatgtgttgtgtagccgccttctgtacccggtgcgatttggtttttaatgcggatattggcgaatgttcctctcatcatgacttcatggtttccgcggcgtgagccgtaagagttaaagtcacgaggagaaacgcctttttcctgcaggtatttgcccgccggtgtgtcttttccgatcgctccggccggagaaatatggtcagtcgtcacggaatcgccgaatttgccgacaacgcgaagtcctcttaaaggctcaacttttcccggctctacagacatttcctcaaagaatggcgggttttgaatgtaagtggaatcctggtcccacttatacagcgcttcatccgtcgtttcgatttcgttccagcgctggttgtcgtcaaataccgtttcatactctttgcggaataattccggcgtaacagtctgtttgacgagagaattgatttcatccatggacggccagatgtcatcgaaataaacattttgtccgtcatttccgacgccgatcggatccgttttcaggttgatgtttacagttcccgccaatgcgtatgcgacaacaagcggcggtgacgcaaggtagtttcctttgacaagcgggtggatccggccttcaaagtttctgttacccgacaggacagaagtgatcaggaggtcatttttagcaaccgcttcttcaatctctggagaaagcgggccggagttcccgatacatgtcgtacagccataccccacaaggttaaagccgagctccttcatgtaaggaagcagacctgagttgactaagtatccagtaacaaccttagaccccggtgcaagtgaagtcttcacataattcggcactttcaagcctaattctaccgcttttttggctaccaatccggcaccgattaatacataagggtttgatgtattcgtacagcttgtaatagcggcgattgcaatcgcccctgttttcataaccgcatcttcaccgctgttaagtttaaatgaaatttctttgttctcttcagcagcatccgctccgaatccttggttgccggccgggctgacaagatgttttttaaacgtttcctgcataacggaaagcgggattaaatcctgcggacgtttcgggcctgaaaggttcgcttcgatttttgacagatcaatttccacaacgtctgtaaaaatcggctcttccgcgtcaggcgtatagaataaaccgttgctgcggcagtatgcttccacaatatcgatctgctcttcttcacggccggtcagacgcaggtaagaaagtgcttcctcgtcaaccgggaagaatccgcaagtcgctccgtattccggcgccatattggcaatagtcgcccgatccgcaagcggaagctcagcaacaccaggaccgaagaattcaacaaatttattgactacgcctttttcacgcagcacttgagtgactttcagcgccaagtcagtcgccgtcgttccgttaggcaattttccgacaagtttcgcgccgatgacctcaggaacagggaaatatgaaggctggccgagcattcccgcttccgcttcaataccgccgacaccccagccgaggacgccgattccgttaatcattgttgtatgggaatcagttcccaccaaagtatcaggataggtcacaagttctccgtcttcctctttcgtatggacaacgcttgccaaaaactcaaggtttacctggtgaacgatacctgttgcaggcggaacggcctgataattgttaaacgctttctttgcccagcttaaaaatttataacgttctgcatttctttcgaattctaagtccatattaatggctaacgcatcttccgtaccggctttgtcaacttgtacggagtggtcaatgaccaggtcaaccggaatttcaggattgattttatcagggtctccgccgacagaggccatggcttttcttaaagatgccaggtcaactacggccggaacgccggtaaagtcctgcagaataacccgtgacggtttaaacggcacatcgatatcttttaattcagcagtaccccatcttgctaaattttcaacatgctcttttgtaatgacgcgtccgtctacctgacgcaaaacggattccaaaagaaccttaatagaataaggaagttttgaaacattgccgacccctgcgtcttccaatgcttttaatgaatagtagttgtatgttttcccatttgaagaaaatgtttttcttgcttggaaaacgtcttgtgttgcgactttttgctgatttgtcattctccaaaatcccccttcaatgatcaagatcgttctttagatgaatgttcacattccatcacaattttctcacaatttcatcttagtataaaatcatacataagtaaatatcaatgtttttattaaatacaataagatcgtcttatcagcatattttcggtaaattttgtccgattttccgcctcatacaacgggctgtaaagagccatattaatgttgaggtgatgatcatggtaaaacggaaagccaatcatgtaattaacggcatgaatgatgcgaaaagccaaggcaaaggcgcgggttatatagaaaatgaccagctcgtcctgacggaagaagaacggcagaacaataaaaaaagaaaaacaaaccaatagccggaacaccttaaaaaggaggctttaacatgacaaataaaaatacgagtaaagatatgcataaaaatgctccgaagggccataaccccggccagccggaaccgctgagcggaagcaaaaaagtgaaaaaccgcaaccatacaagacaaaaacataatacaagccacgatatgtaaaacagaccccggtgtctgtttttttgtgccattcacccatttaaagcttctgcatacgttatagcaaggctttttaatatggaggaatgcttccatgaatcactcaaaaaacgctgaagaatttgatgatacggaagaatggctgcggcagttttacgaggacccgtatgcttggtatgacgagacgctgccgatcgatctatatgaaacaagccgtcagtatatcattgaagccgacctgacggccctgaagcaggtgcaggcgatcaccgtcactctttcgggaaatgagtttatgctctctgttaaaacgcttgaacggacattaaacaaacaaatggtgcttcctttttatctgaatgacaaacatattttcactgatttcaccaaccatattctgaccgtctccatgaacaaggagcctaatgagactcctgcctcattttcctttcaatttcctctataacataaaaaagccgctttcatccctcaatggaagcggcttttttgtccggtcatatcagtcatataccctcaaagtgaatctcccatggccaaatagcagaatcactatacgatagaatatgttctagcaaccgaattgactggacatctatcattttttctattctttttttcatgtgttcttctattctgtcttcgtttacaatatggttaaagtaaggaggagatagaacaatgctagaaggctggtttatgtggtttattttattttgggtcatcgtgatgatcggattgctgtctatcggcggattttttatgttccgaaaatttttaaaacgcttaccgaaagaagacggccggtcagaactggattggcaggactattatattgaaaaaagcaggcacttatggaatgcgggtgacaaggcgtttttggatgaattggtcgctcccgtgccggagctctttcgggatgtagccaaagcgaaaatcgccggaaaaatcggtgaactttccttagcggaggaagctgaacaaataaatcgtgatttaatcatcaggggttacatactggccactcctaagcgtgatcatcaatttttaaaaaagcatctccgcgaaaaacagattgatcttactccttatcaggccctgctcaaataaaaaacctttccggcggacggaaaggttttaattcatctgaatatcagcggtcttcagttcattcgaaagtttgcggtaagacataaacatcgcgatgcgccacggaacaatcattccgaaagccagaatccaaaacattccgcttaaagctccgtaatcaatcgtcgtgctcaaaatggatttcatagcgattctgataaccagcaaaccaatcaggataaacacaaacgcttttgaccgttttaaatagatttcattatttttaatctcaaatttagatgttttaatcagaaaaatagagaagatcacgcccagcgtaatggcctccaaaaattcttcgcccgtcactctgaaaatcggaaaaaggaacataagcgctcccgtactcatgaaaatcggcgggagaattatttttttaggtgaagcgggcttgtcggaggctttaatcctgacgatcatcacggaaatggccatggccgctgcaataacggatgaaattataatcatcatctttatcattcctttgcttgcacggagtttgatactatatactatactccaaaaacataaaaaaaaccaatttgaaaagagaacacgtttacgttcccgttacccggcctacggcctccagcactttagatgcttcaaacggtttaacgataaagtctttagcgcctaattcaatcgcttccagaacgatccgctgctgccgcatggcggtgcacatgatgatccgggctttcgggtcaaaagctaaaatatcctgcagcgcctgtataccgtttttgaccggcatggtaatatccattgtcaccaggtcgggacggattttttgatatactgccagggcttcctcgccgtcagccgcttctccggccactgtgtaattcgccgtttccagaatctctctgattttcgccctcatgaacttggcgtcatctacaactaaaactcgtgtcatattcccctccacatatttaacattaactagtcttattgtaccaaaaacgaaagggtatataatagttcaaaagttattaatccgttacagacccgtaaatcctccgaaaagatttgacagaacgatcagaatgtagctcatccagttaaaaaacagcataactccgatcagaatcataagaatgccgccgattttcatgataagcagctgatgcttgcgaatccaattcattctggtaataaaaaatgaaagaacaagaaaaggaatcgcaaaaccgagaacatataaaaacatatacggcactgctgaagaaggatttgtatttgccagcgaaaacacggctcctaaaataggcccgctgcacggcgaccagccggctgcaaacgcaagaccgatcagaaccgaaccgataaacccctccggacggcgcttaaagtgaatgcgccgctctttcatcatgaatttcggctgaaacacaccggcagtaatcagcccgaaaagaatcagcatgatagcgccaaactggcggatcgcttcatgatattgggtaaaaaaactgccgataaacgaagttccatatcccaatgcgataaaaatcacggagaagccaagcaaaaaacaaagtgtatgcacgaggccacgcttttgcagcatcaccttttctgttttcacctcgtccatactgacaccagttatgtaagataaaaaggcggggtacaacggcagacagcatggagaaatgaaagacagaaatccggccccaaacgtcagaaagtaattaaaactcacgatgacacactcccttcgagttatgacaaaatcatttcatttttttaacactttcccgagaaggattactttttatagaaaaagcttatataatttaatttgacatcgagatattatactccttcttatttgaaaaacagtataaatgtggatataataatagcgactcaggtgaaagatttatgtatgaaaggatatatccctgtgattagagagcatctattaaatgaaattgaaaaaaaacgggcagagctgcttaaaatcgtcatgacaaacggaatgacatcaaacattacgatagaactcagccaggagcttgaccaccttctcatacaataccaaaaagaactgcacaccggcagttggggtgaaacatgacgcaaaaataaaaaaccctctccgggttttttatttttataaccatgtatctctatatcataatctgtacgtattatttcgcttgattattcatggctttcatcatttgattaattttcttttgagaaggtttcattcccatttgcatcatcatcatgcgtaacatttgttcattaataggcggattctttttcaaatagctcatcatatatttacgagcaataaaaaacccgagtgcaaca
